United States Patent
Wu et al.

(10) Patent No.: US 7,604,945 B2
(45) Date of Patent: Oct. 20, 2009

(54) SINGLE NUCLEOTIDE POLYMORPHISMS IN PROTEIN-TYROSINE PHOSPHATASE RECEPTOR-TYPE DELTA FOR THE DIAGNOSIS OF SUSCEPTIBILITY TO ASTHMA

(75) Inventors: Shih Hsin Wu, Taipei (TW); Ellson Ye-Shyon Chen, Taipei (TW)

(73) Assignee: Vita Genomics, Inc., Taipei (TW)

( * ) Notice: Subject to any disclaimer, the term of this patent is extended or adjusted under 35 U.S.C. 154(b) by 0 days.

(21) Appl. No.: 12/018,792

(22) Filed: Jan. 23, 2008

(65) Prior Publication Data

US 2008/0187932 A1  Aug. 7, 2008

Related U.S. Application Data

(62) Division of application No. 11/328,881, filed on Jan. 10, 2006, now abandoned.

(51) Int. Cl.
*C12Q 1/68* (2006.01)
(52) U.S. Cl. ......................................................... 435/6
(58) Field of Classification Search .................. None
See application file for complete search history.

(56) References Cited

U.S. PATENT DOCUMENTS

| | | | |
|---|---|---|---|
| 5,753,687 A | 5/1998 | Mjalli et al. | |
| 5,821,075 A | 10/1998 | Gonez et al. | |
| 5,858,701 A | 1/1999 | White et al. | |
| 6,525,083 B2 | 2/2003 | Acton, III et al. | |
| 6,569,879 B2 | 5/2003 | Liu et al. | |
| 6,645,997 B2 | 11/2003 | Sahoo et al. | |
| 6,713,508 B2 | 3/2004 | Sahoo et al. | |
| 2002/0042441 A1 | 4/2002 | Acton, III et al. | |
| 2002/0103242 A1 | 8/2002 | Sahoo et al. | |
| 2002/0150947 A1 | 10/2002 | Erlanson et al. | |
| 2002/0173663 A1 | 11/2002 | Liu et al. | |
| 2002/0177166 A1 | 11/2002 | Guthridge et al. | |
| 2002/0183518 A1 | 12/2002 | Mjalli et al. | |
| 2003/0064380 A1 | 4/2003 | Rao et al. | |
| 2003/0104404 A1 | 6/2003 | Wise | |
| 2003/0143606 A1 | 7/2003 | Olek et al. | |
| 2003/0144338 A1 | 7/2003 | Matsumoto et al. | |
| 2003/0170660 A1 | 9/2003 | Sondergaard et al. | |
| 2003/0194745 A1 | 10/2003 | McDowell et al. | |
| 2004/0029123 A1 | 2/2004 | Olek et al. | |
| 2004/0073037 A1 | 4/2004 | Jones et al. | |
| 2004/0092583 A1 | 5/2004 | Shanahan-Prendergast | |
| 2004/0092596 A1 | 5/2004 | Adams et al. | |

OTHER PUBLICATIONS

Burney, P.G.J., "*The European Community Respiratory Health Survey*", Eur Respir J. 1994, 954-960.
Lander, et al., "*Mapmaker: an interactive computer package for constructing primary genetic linkage maps of experimental and natural populations,*" Genomics 1:174-81 (1987).
Mustelin, et al., "*Protein tyrosine phosphatases and the immune response,*" Nature Rev. Immun. 5: 43-57(2005).
Pearce, N. et al., "*Comparison of asthma prevalence in the ISAAC and the ECRHS*", Eur Respir J. 2000; 16: 420-426.
van Huijsduijnen, et al., "*Selecting protein tyrosine phosphatases as drug targets*", Drug Discov. Today 7:1013-9 (2002).
Wang, Jiu-Yao, et al., "*Discovery of genetic difference between asthmatic children with high IgE level and normal IgE level by whole genome linkage disequilibrium mapping using 763 autosomal STR markers*", J Hum Genet (2005) 50:249-258.
Zhang, et al., "*Protein tyrosine phosphatases: prospects for therapeutics*", Chem. Biol. 5:416-423 (2001).
Zhao, Jing Hua, et al., "*Genecounting: haplotype analysis with missing genotypes*", Bioinformatics, vol. 18 No. 12 (2002), pp. 1694-1695.

*Primary Examiner*—Ruixiang Li
(74) *Attorney, Agent, or Firm*—Baker & McKenzie LLP

(57) ABSTRACT

A gene related to a susceptibility of infection and asthma—the Protein-Tyrosine Phosphatase Receptor-type Delta (PTPRD) gene—a method of detecting the asthma-associated gene, a method of predicting the occurrence of asthma, a method of identifying asthma-associated alleles in PTPRD gene, a method of screening PTPRD for drugs useful in the treatment of asthma, and antibodies specific for PTPRD variants and their use in diagnostic assays.

2 Claims, 1 Drawing Sheet

SINGLE NUCLEOTIDE POLYMORPHISMS IN PROTEIN-TYROSINE PHOSPHATASE RECEPTOR-TYPE DELTA FOR THE DIAGNOSIS OF SUSCEPTIBILITY TO ASTHMA

PRIOR RELATED APPLICATIONS

This application is a divisional application of U.S. Ser. No. 11/328,881, filed Jan. 10, 2006, now abandoned entitled "Single Nucleotide Polymorphisms in Protein-Tyrosine Phosphatase Receptor-Type Delta for the Diagnosis of Susceptibility to Infection and Asthma," which is incorporated herein in its entirety.

FEDERALLY SPONSORED RESEARCH STATEMENT

Not applicable.

REFERENCE TO A SEQUENCE LISTING

A "Sequence Listing" with sequences labeled SEQ ID NO: 1-75 is attached hereto. A compact disc containing a Computer Readable Form (CRF) labeled "SEQUENCE LISTING.txt" is incorporated by reference. The copy in CRF is identical to the compact disc copy of the "Sequence Listing" submitted herewith.

FIELD OF THE INVENTION

The present invention relates to the Protein-Tyrosine Phosphatase Receptor-type Delta (PTPRD) gene, which is related to the susceptibility of infection or asthma and various methods relating to same, including a method of detecting the asthma-associated gene, a method of predicting the occurrence of asthma, a method of identifying asthma-associated alleles in the PTPRD gene, a method of screening PTPRD for drugs useful in the treatment of asthma, and antibodies specific for PTPRD variants and their use in diagnostic assays.

BACKGROUND OF THE INVENTION

Asthma is a chronic airway inflammatory disease and affects nearly 155 million individuals worldwide. The population of asthma sufferers has been documented since 1970 and has increased continuously since then. A survey in 1994 by the U.S. Department of Health and Human Services identified over 12 million Americans suffering from asthma, almost 5 million of them under the age of 18. In addition, a patient's condition becomes more serious over time, resulting in increased hospitalization and possibly death.

Inheritance plays a strong role in some allergic diseases, including asthma. People whose relatives suffer from asthma are also at high risk of asthma. However, if allergic factors are reduced or removed early, it may possibly prevent the development of asthma. Many approaches have been proposed to determine if there are any allergen-specific IgE antibodies in the serum, but traditional IgE tests are limited to specific allergens and cannot detect asthma at such a low sensitivity. In addition, the preferred age for testing is above three years old and 6-8 c.c. of blood is required, thus limiting the usefulness of this test.

Another possible test for asthma would involve determining an individual's genetic predisposition for asthma. Genotypic diversity is assumed to underlie the heritable phenotypic differences observed as variations in drug response, susceptibility to disease, and other complex traits. Single Nucleotide Polymorphisms (SNPs) are the most common genetic variation and are of great value to biomedical research and in developing pharmacy products. SNPs make up 90% of all human genetic variations and occur every 100 to 300 bases along the human genome. Because SNPs do not change dramatically from generation to generation, following them during population studies is straightforward.

What is needed in the art is a method of identifying susceptibility to asthma and infection, which can be used to identify individuals with increased disease susceptibility even before disease is manifest, and thus allow those individuals to take measures to prevent disease.

SUMMARY OF THE INVENTION

To study the genetic disposition to asthma, a whole genome linkage disequilibrium mapping study was conducted by Wang, et al. on 190 allergic and non-allergic asthma children in Taiwan (25), the disclosure of which is incorporated herein in its entirety by reference. The linkage disequilibrium map identified populations and genomic regions with strong and weak associations with asthma. According to Wang, et al., the marker to marker synergetic analysis indicated six STR loci may play an important role in the incidence of asthma, one of which was near the PTPRD gene, and is described and claimed herein. The identification of a unique, common, and non-biased marker for asthma would provide a diagnostic and predictive tool for this debilitating disease, allow treatment or prevention before symptoms were manifested, and prevent mis-diagnosis once asthma symptoms were observed.

One aspect of the invention provides a method for predicting the occurrence of asthma by examining the polymorphisms of the PTPRD gene. The method has high prediction precision without restriction to the age, requires smaller and less invasive samples, and does not require that the patient to exhibit the physical symptoms of asthma. The invention is also useful for the determination of increased susceptibility to infection, particularly respiratory infections, which can be exacerbated by asthma.

Mucous fluids, blood samples, tissue, sinovial fluids, or other biological samples are taken from patients who would like to know their susceptibility to asthma. Nucleotide sequences, such as DNA, mRNA, or cDNA from the samples are subjected to genotyping. The genotyping may be conducted by a variety of techniques, including sequence-based methods, hybridization-based methods, restriction polymorphism-based methods, and combination methods, all of which are well known in the art. The method can also include amplification techniques, such as TAQMAN®, MC-PCR, or SNAPSHOT.™ By examining the genotypes of an asthma-linked gene, such as PTPRD, non-symptomatic individuals that are highly susceptible to asthma may be identified and monitored. Preventative measures may be employed to reduce and control the prevalence of asthma and related infections.

Furthermore, the invention provides a method of identifying additional alleles, such as SNPs, that may be associated with asthma. At the first step, one or more biological samples from a population of patients are obtained. The patients are evaluated for the clinical symptoms of asthma or infection. One or more alleles or SNPs in the PTPRD gene are selected for the biological samples to be tested or new alleles can be identified. Then, the SNPs that are associated with asthma or infection are identified by correlation with the two patient groups. Once an SNP associated with asthma is identified, additional mutations that occur in the same haplotype will also be associated with asthma. Hence, any SNP in a given asthma-associated haplotype can be employed in methods of the invention.

In order to achieve the above and other objectives of the invention, isolated nucleic acids that are complimentary to PTPRD genomic DNA are also provided. These nucleic acids usually comprise an SNP or other allele and correlate to an increased susceptibility of infection or asthma. Two specific nucleotides of the present invention are the SNPs at rs2279776 and rs767674, and specific oligonucleotides for detecting a C allele at rs2279776 and a G allele at rs767674 are also disclosed.

A screening method for an asthma treatment drug is further provided. A PTPRD protein or polymorphic variant thereof is contacted with a test agent. Then, the activity of PTPRD protein or polymorphic variant thereof is measured. In this embodiment, a decrease in PTPRD activity is used to identify an agent for treating asthma. The polymorphic variant of PTPRD may be selected from the group consisting of I130M, E447Q, D1078E, or V1486D (see Table V), but other alleles will also suffice.

Antibodies for diagnosing asthma are also provided. The antibodies include those that bind specifically to an asthma causing PTPRD epitope, such as I130M, E447Q, D1078E, or V1486D. Antibodies also include those that bind to both wild type and variant PTPRD, and those that bind only to wild type PTPRD.

In still another aspect of the invention, methods for the detection, diagnosis, and screening of disorders related to the polymorphisms of PTPRD gene are provided. The role of PTPRD in disease is not yet understood, but it is a receptor-type protein-tyrosine phosphatase expressed in the specialized regions of the brain and PTPRD-deficient mice are semi-lethal due to insufficient food intake and have learning impairments. This suggests an important role in brain development and learning, and possibly in hunger regulation, and indicates that the invention has broader application that herein exemplified.

DETAILED DESCRIPTION OF THE INVENTION

Figure 1:
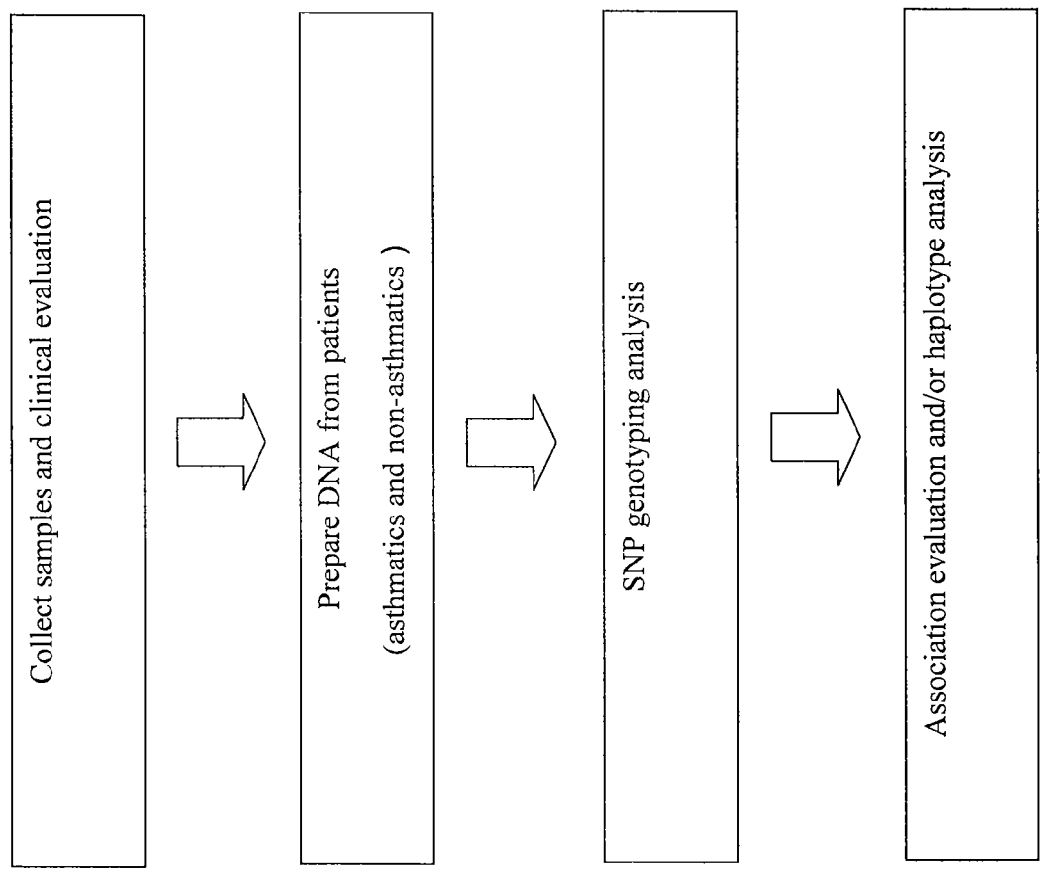
FIG. 1 is a flow chart for the detection of PTPRD gene loci related to susceptibility to infection or asthma.

As used herein "recombinant" is relating to, derived from, or containing genetically engineered material.

"Single Nucleotide Polymorphism" or "SNP" refers to single-base pair variations within the genetic code of the individuals of a population. SNPs and other alleles can be identified de novo through population analysis or can be selected from numerous databases including the National Center for Biotechnology Information (NCBI) SNP database (dbSNP), the SNP Consortium (TSC) database, Human Genome Variation Database (HGVbase), and the ABI database (Applied Biosystems, Foster City, Calif.).

"Protein-Tyrosine Phosphatase Receptor-type Delta" or "PTPRD" variants of which are found at GenBank Acc. # NP_002830, NP_569075, NP_569076, and NP_569077. The genomic DNA which encodes PTPRD can be found at GenBank Acc. # AL137125, AL356584, AL445926, AL583805, and AL590397. The PTPRD gene is located on chromosome 9 (NC_000009) with about 1833 SNPs identified to date.

"Molecular beacon," "marker," and "probe" are used interchangeably to reflect various labels that can be used to bind or mark specific nucleic acid sequences.

As used herein the term "test agent" refers to a candidate drug that is being tested for efficacy against a given target protein.

According to one embodiment of the present invention, a gene for asthma prediction may be found by genotyping analysis, as illustrated in FIG. 1. A genetic contribution to the pathogenesis of asthma has long been inferred from the increased prevalence of asthma in families. The D9S286 locus is one of the six STR loci identified by Wang, et al. (25). Searching DNA databases, the D9S286 locus was located on chromosome 9 p-arm at a physical distance of 8.04 MB from the p-terminal of the PTPRD gene. The PTPRD gene at NC_000009 spans 416.68 kb and has 35 exons.

Protein tyrosine phosphatases (PTPs) form a large family of enzymes that serve as key regulatory components in signal transduction pathways. The cells of the immune system express at least half of the 107 protein tyrosine phosphatase (PTP) genes in the human genome. Moreover, PTPs have a crucial role in both the maintenance of a resting lymphocyte phenotype and the reversion of activated lymphocyte to a resting state during the termination of an immune response.

Due to proximity to the D9S286 locus and possible role in immune response, the protein translated from PTPRD gene may also play an important role in the diagnosis and treatment of asthma. Of the many SNPs associated with the PTPRD gene, 72 SNPs (SEQ ID NO: 1-68) are shown in Table 1. Using association evaluation, polymorphisms in the PTPRD gene were correlated with a susceptibility to asthma. A patient having at least one C allele at rs2279776 had an increased risk of asthma, and a patient homozygous for a C allele at rs2279776 had a greater risk of asthma. Likewise, a patient heterozygous for a G allele at rs767674 had an increased risk of asthma and a patient homozygous for a G allele at rs767674 had a greater risk of suffering asthma. By examining these two loci of PTPRD gene, the susceptibility to asthma may be evaluated as low, medium, and high risk of asthma.

The Hardy-Weinberg equilibrium (HWE) test, linkage disequilibrium (LD) test, in-silico haplotype reconstruction module, and SNP (or haplotype)-phenotype association module are some known analysis tools which help associate SNPs (or haplotypes) with phenotypes. Chi-square test and SAS are used here, for example. There are many analysis programs available including ARLEQUIN® (Schneider, et al., Genetics and Biometry Laboratory, Geneva, Switzerland); CIA® (Gardner, British Medical Journal, 1989); MAPMAKER™ (Lander, et al. Genomics 1:174-181); GENECOUNTING™ (Zhou, et al., Bioinformatics 2002, 18:1694-1695); HAPLO™ (Hawley and Kidd, J Hered 1995, 86:409-411); and SNPHAP™ (Clayton, Addenbrooke's Hospital, Cambridge, CB2 2XY).

The genotyping analyses of PTPRD SNP allele frequency and genotype frequency allowed association with the asthmatic phenotype. Allele frequency and genotype frequency differences were calculated by using $\chi^2$ test to obtain alleles with significantly different frequency between asthma-infected and non-asthma-infected DNAs. Moreover, SNPs with a p value <0.05/72 (0.0007, Bonferroni correction) in allele by using $\chi^2$ test were selected to limit the number of SNPs analyzed. Two SNPs, rs2279776 and rs767674, that correlate to a susceptibility to infection or asthma were identified.

The method comprises sampling genomic DNA, mRNA, or cDNA extracted from tissue, blood, mucous and sinovial fluids, and other patient samples and detecting polymorphisms or other alleles associated with asthma. Patient samples are analyzed to identify the genotypes of loci rs2279776 and rs767674, or those SNPs associated therewith by virtue of being in the same haplotype. The susceptibility to asthma is then assessed for each patient as low, medium, or high based on the genotype at rs2279776 and rs767674.

EXAMPLE 1

Study Population

A population of 1000 asthmatic children between 1 to 12 years old was analyzed. "Asthma" was diagnosed through the three following conditions: (1) History of wheezing and shortness of breath with or without respiratory infections; (2) Chronic cough for more than one month and/or one or more wheezing episodes in the presence of a physician; and (3) Bronchodilator test with a positive increase of 15% for FEV1.

Other evaluations included skin prick tests for responsiveness to 6 common aeroallergens, a differential blood count (including total eosinophil count), and measures of total serum IgE, as well as IgE specific to house dust and mixed pollens using UNICAP™ system (PHARMACIA DIAGNOSTIC™, Sweden). A positive skin test was defined as the presence of ≧1 reaction with a wheal diameter ≧5 mm. Total serum IgE was measured by solid-phase immunoassay (PHARMACIA™ IgE EIA).

The study protocol was approved by the Ethical and Clinical Trial Committee of National Chen-Kung University Hospital. All participants or their guardians were well informed and signed consent forms and answered a modified British Medical Society respiratory questionnaire that is identical to the European Community Respiratory Health Survey (ERCHS). Questions were similar to those used in the International Study of Asthma and Allergies in Childhood (ISAAC) (Burney, et al., 1994; Pearce, et al., 2000), as well as additional questions pertinent to the diagnosis and assessment of asthma. Pulmonary function was tested using standard methods that included spirometry before and after the administration of two puffs of inhaled salbutamol (200 ug/puff).

EXAMPLE 2

Sample Preparation

Genomic DNA was extracted from blood samples for 1000 children using QIAAMP™ DNA Blood kit (QIAGEN) by following the manufacture's instructions. The extracted genomic DNA was confirmed by agarose gel electrophoresis analysis, quantified by spectrophotometer, and stored at −80° C. until use.

All SNP genotypes were analyzed using the TAQMAN® SNP genotyping assays (APPLIED BIOSCIENCES™) and 1 to 20 ng of purified genomic DNA. 2×TAQMAN® Universal PCR Master Mix, without AMPERASE® UNG, and 20×SNP Genotyping Assay Mix were used, wherein the SNP Genotyping Assay Mix contained: (1) sequence-specific forward and reverse primers to amplify the SNP of interest (See Table IV for primer sequences); and (2) two TAQMAN® MGB probes labeled with VIC™ dye for Allele 1 and FAM™ dye for Allele 2. The reaction mixture was PCR amplified and an endpoint measurement was used to detect each allele.

Specifically, reaction mix was prepared by gently resuspending 2×TAQMAN® Universal PCR Master Mix. The 20×SNP Genotyping Assay Mix was vortexed and centrifuged briefly. 5 µl of 2×TAQMAN® Universal PCR Master Mix and 0.5 µl of 20×SNP Genotyping Assay Mix were pipetted into a sterile tube. Finally, the tube was inverted to mix and centrifuged briefly to collect the contents.

The reaction plate was prepared by diluting 1 to 20 ng of each purified genomic DNA sample into DNase-free water to a volume of 4.5 µl. Control or sample was pipetted into each well of the 96-well or 384-well optical reaction plate and reaction mix added to a total volume of 10 µl. The plate was centrifuged briefly to collect the contents and to eliminate air bubbles. Finally, the plate was covered with an optical adhesive cover.

Amplification and the fluorescence signal detection were carried on ABI prism 7900 Real-Time PCR System with following thermal reactions: one cycle of warming up at 95° C. for 10 minutes, 40 cycles of denaturing at 92° C. for 15 seconds and annealing/extending at 60° C. for 1 minute.

EXAMPLE 3

Alternate Sample Preparation

In another embodiment of the invention, the genotyping of a patients PTPRD gene was conducted by SNAPSHOT™, wherein each reaction contained 2.5 µl of 10×Reaction Buffer, 0.5 µl of 10 mM dNTPs, 2.5 µl 25 mM $MgCl_2$, 16.375 µl sterile deionized water, 1.0 µl primer pair (5 µM each primer), 1 µl genomic DNA (10 ng) and 0.125 µl of 5 U AmpliTaq Gold® for a total reaction volume of 25 µl/well. Amplification and the fluorescence signal detection were performed using an ABI prism 7900 Real-Time PCR System™ with following conditions: One cycle at 94° C. for 12 minutes, 35 cycles of melting at 94° C. for 30 seconds, annealing at 58° C. for 45 seconds, extending 72° C. 1 minute, 1 cycle at 72° C. for 10 minutes and hold on 4° C.

The amplification was followed by Exo-SAP™ reaction whereby Shrimp Alkaline Phosphatase (SAP) dephosphorylates residual deoxynucleotides preventing them from participating in sequencing reactions, and Exonuclease I degrades excess ssDNA (primers) from sample. The Exo-SAP mix included 0.2 µl of exonuclease I (10 U/µl), 0.2 µl of SAP (2 U/µl)–0.6 µl of SAP (1 U/µl), 0.2 µl of sterile deionized water, and 5 µl of PRC product (total 7 µl/well). The Exo-SAP program is one cycle at 37° C. for 45 minutes, following by 94° C. for 15 minutes and finally a hold at 4° C.

Then, the SNaPshot™ reaction was conducted. The total volume of SNaPshot™ components was 10 µl/well including 1.25 µl of SNaPshot™ reaction mix, 2 µl of 1 µM probe, 1.5 µl of 3×sequencing buffer, 2.25 µl of sterile deionized water, and 3 µl of diluted Exo-SAP treated product (total 0.01-0.04 pmol). The SNaPshot™ program was one cycle at 96° C. for 5 minutes, 25 cycles of melting at 94° C. for 10 seconds, annealing at 50° C. for 5 seconds, extending 60° C. 30 seconds, 1 cycle at 60° C. for 5 minutes, and finally a hold at 4° C.

In order to remove excess labeled ddNTPs, the post-extension reaction was carried out, wherein the components were 1 µl of 1 U SAP and 10 µl of SnapShot® product and the program was one cycle at 37° C. for 1 hour, followed by one cycle at 75° C. for 15 minutes and a hold at 4° C.

Reaction components were analyzed on a 3700 DNA analyzer, including 9 µl of Hi-Di formamide, 0.15 µl of GeneScan LIZ120, and 0.85 µl of SAP treat SNaPshot™ product. The products were denatured at 95° C. for 5 minutes and quenched at 4° C. Finally, the fluorescence signal was detected using the SNP_POP5_CT49RT60 module.

EXAMPLE 4

Asthma Association

To determine the relationship between asthma and PTPRD SNPs, association analyses including allele frequency and genotype frequency were performed by $\chi^2$ tests or Fisher's exact tests using standard software packages. All statistical analyses were performed by SAS® (SAS INSTITUTE INC.™, Cary, N.C.).

$\chi^2$ tests identified the significantly higher frequencies of the rs2279776 and rs767674 polymorphisms in asthmatic patients compared to normal subjects, wherein the frequency of the homozygous form of C allele in 100 asthmatic subjects and 53 normals at rs2279776, and the frequency of the homozygous form of G allele in 152 asthmatic subjects and 96 normals at rs767674 were determined, as shown in Table II and Table III ($\chi^2$, p<0.05). Patients with a homozygous C allele at rs2279776 or a homozygous G allele at rs767674 of PTPRD gene have higher risk of suffering asthma as compared with patients having at least one G allele at rs2279776 or A allele at rs767674, respectively.

EXAMPLE 5

Patient Diagnosis

In another aspect of the invention, a method of screening potential asthmatics by identifying the asthma-causative gene among those currently non-asthmatics is disclosed.

Mucous membranes, blood samples, or any biological samples are taken from patients who would like to determine if they have a susceptibility to asthma. This may be particularly useful in those patients with a family history of asthma. Samples are subjected to genotyping by SNAPSHOT™ or any other method, whereby the sample is genotyped at the PTPRD gene, preferably at loci rs2279776 and rs767674 or an allele in the same haplotype. Those with a C allele at rs2279776 or G allele at rs767674 are regarded as potential asthmatics, and those with a homozygous C allele at rs2279776 or a homozygous G allele at rs767674 have an even higher susceptibility for asthma.

EXAMPLE 6

Asthma Drug Screening

Now that a protein that contributes to asthma has been identified, it will be possible to use the PTPRD protein as a target in drug screening for potential asthma drugs. In such method, the wild type or variant PTPRD is tested against a drug library and those compounds that change PTPRD activity are identified as lead compounds for use in asthma treatments.

EXAMPLE 7

Antibody-Based Diagnostics

The PTPRD gene also has asthma-associated alleles that manifest as changes in the primary amino acid sequence. Such protein variations can be used in antibody-based testing methods, whereby antibodies can be generated and are specific to these alleles, as shown in Table V. In addition, antibodies that are specific to the wild type PTPRD or antibodies that will bind to both wild type and variant PTPRD can be used as a control to indicate whether a patient is homozygous (only one signal) or heterozygous (two signals) at the loci in question.

Realizations in accordance with the present invention have been described in the context of particular embodiments. These embodiments are meant to be illustrative and not limiting. Many variations, modifications, additions, and improvements are possible. Accordingly, plural instances may be provided for components described herein as a single instance. Additionally, structures and functionality presented as discrete components in the exemplary configurations may be implemented as a combined structure or component. These and other variations, modifications, additions, and improvements may fall within the scope of the invention as defined in the claims that follow.

TABLE I

SNP Sequences near or within the PTPRD genomic DNA.

| SEQ ID | ABI # | NCBI #: | SNP | Sequence |
|---|---|---|---|---|
| 1. | hCV8781206 | rs3843579 | C/G] | TGTGTGTGTCATGATTCTAGATTGTNCTAACCTATCCAGCAAGTTCAAAAC |
| 2. | hCV8781198 | rs996924 | A/G | CCCAGACAAGTGTTTTCCAAGTAGTNTCAAACCATTACCACCAATTGAACA |
| 3. | hCV11260659 | rs12001948 | C/G | AATTCATAGCTCTTGTGCACTTAAGNAGGAAAGCAATGGGAAGTTCAGATA |
| 4. | hCV1430259 | rs10739155 | A/C | AAGGATGCTAGAAGGGACTTTAAACNTCAGCTAAGATAACTGAAGTCCAGA |
| 5. | hCV1430252 | rs10815823 | C/G | TCCTGACTGATGTTATTTGGGGATGNAGATAAACAGGAAGATGACACCAAG |
| 6. | | rs3780336 | A/C | GCTTTCATTCAAACATAACATCTGGNAGCTCAACCTTGGGGATGCACTTGG |
| 7. | | rs1500318 | C/T | ACTCTGTAATCATTTTGAAACTTCANGCTATAAAAGACTTCAGATGTAGAA |
| 8. | | rs1500322 | C/G | GGCCAGAATATAGCAATGTGGTATGNAATCAGAAAGGAAGGAGTGGCTCAT |
| 9. | | rs1039336 | A/G | GACAAATATTTGCGCAGGAAGACAANATTCTTAGGTGAGAAGCATTATATT |
| 10. | | rs1566447 | C/T] | AAATGGCTGAGTGATAATGGAAGATNTATTTCATTCTTCACTGTTGCCATT |
| 11. | | rs989815 | C/G | TTCTAATTCACAGCAGCATTTACAANACGCACACATATTTTCTTCATGTAC |

TABLE I-continued

SNP Sequences near or within the PTPRD genomic DNA.

| SEQ ID | ABI # | NCBI #: | SNP | Sequence |
|---|---|---|---|---|
| 12. | | rs2279776 | C/G | CAATATAGGCATTTTGCTTCCTATANCCATCTATGTAGTTGGCATTCACAT |
| 13. | | rs1500331 | C/G | CATTTCAGGTAAGTTCTCTCTCACANATCCTCTGCAAATGTGGAGATAAGA |
| 14. | | rs1392524 | A/C | TCCATTTATCAAGCACCAGTGTTTTNTTTTGCATTACAGAGTACTTCAAAT |
| 15. | | rs1021720 | A/C | CTTTTCCACCCATGCTAAGTGACTTNAGACACTGTCACATCCTGCACCGGT |
| 16. | | rs1875239 | C/T | GAAGAAGCCCAACTTAAGAAACACANCTACACATCACTATCCTTTATTTCA |
| 17. | hCV7580286 | rs3903826 | C/T | GCAGCTTTTGACTAAACCTTTCTAANGCTAACAACAGATCTTCAACTCAAA |
| 18. | hCV3046499 | rs4742500 | C/G | GTCAGTTAGTAGGAGAGAAAGCAAGNCACAGACATGCAGACAATGGAGGG |
| 19. | | rs1535677 | C/G | ACCCTCCATCCTTGTCACCCTTTACNTTCCCCTAATTGCTTTCATAGAGCT |
| 20. | hCV1634600 | rs10977105 | C/T | AAAGAATGACATGCACCACGACTCANTGACGATAATCACTGACGGCACAAT |
| 21. | hCV1634601 | rs10815874 | C/T | TGGTCTGGAAGTATTATATTGGAAGNTTATTAAAGAAAAATTCAAGCAGAC |
| 22. | hCV1634606 | rs7853571 | A/C | TGAGGAATCTGATCCCATACCCCGTNCACTCTCATTTAGCACATTTCACAT |
| 23. | hCV1634612 | rs10977113 | G/T | TTTTTAAGATGCCAAGTTATCCTAANGCCTAGGATAATCGGGACCAGGTAA |
| 24. | | rs1323590 | A/G | TAAAGGTCAGCCTCACCATACACCTNGGTACATATGTGGTACAAATATCTA |
| 25. | | rs1407972 | C/T | TTAAAACTTTTATCTCTGGCTCTCTNAATTTTGAATTAAACCAGTCCCATC |
| 26. | | rs1359119 | A/G | TTTTACAAGGAGCAAGGGGCAAAATNTTAAGGCCAACAAAGATTAGACAGG |
| 27. | | rs2296100 | A/G/T | TTAGCCCACATAAATACCTAGTAGTNCTGTTGTTTATACAAACCTAAAATG |
| 28. | | rs767674 | A/G | TGCCAACCACGGCAAGTGACACAGCNTGGCACGGAGCTTCTTGTAATACCT |
| 29. | | rs767675 | A/G | ATACCTGACCGTGTTACATTAACCANTCTAGAAAACAGGAGTAGTAACCTT |
| 30. | | rs2296102 | G/T | TTTGTCATTTATGAGCATGTTCTTANTAACTGATGTTTCACTTTATAATAT |
| 31. | hCV11260427 | rs6477311 | A/T | TACATAGAGGTATGTTCCTAAAAAGNTATTTGAAGAGTGATTCGGGCAGAG |
| 32. | hCV1634689 | rs10124277 | C/T | TTGTTTTAGGACAGAAGAAAGTAGANTCCATCAGCAAAATTGCAGTTTAGA |
| 33. | | rs1538192 | C/G | AACTCCTGACTCAAACCAAACCGGANTACAGTATGGTCAAGAATTAGAAAC |
| 34. | | rs3763653 | C/T | AACCTCCAGGAACTCCTGTAGTGACNGAGAGCACAGCTACAAGCATCACAC |
| 35. | hCV1634718 | rs7039690 | A/G | ATATAACATTATTTCACGATTGTAANTGTTGACAATGTGTACCTTTGTTCT |
| 36. | | rs1407970 | C/G | GTCCCACCATAATGGTCGACCATGTNTAAAATTCCTAGTTCTGTCTGGTTA |
| 37. | | rs3818346 | C/T | CATTAGTCACTTGGCTTGAGTGTACNCGATCCTCAAAGCATAATCCATTG |
| 38. | hCV1634734 | rs7046918 | A/G | TAATGGCTAAAAAGCCCAGGAGTGNACCACTCAGTTTTTTGTTGAGGCA |
| 39. | hCV1634737 | rs10815909 | G/T | TTTTGTGATTCATAATCAAATAAACNCATTGAGAAAAAAAGAAGTACCTT |
| 40. | hCV1634743 | rs13298042 | A/T | CAGTCATGTCTTCCCTTGGGAAGCANTGTCATGTATTTGAGGCACTCATGA |
| 41. | hCV1634752 | rs7855892 | C/T | CCCTTCCTTAAGTGACTTTAACCTCNGTAGGCATTGGGCCCCATGACCCAT |
| 42. | hCV1634763 | rs13294631 | C/T | ACGGAAACAAATGTAACTGATACATNTGAAGCAAGAGGAGATTGAAGATGA |
| 43. | hCV11260346 | rs10511500 | A/C | ACGCTTATCAAAAAGAACTGGGGTANGTTATTCATCAAAGTTTTATCATTA |
| 44. | hCV1824069 | rs10815918 | C/T | CTTTCCATTTTAGTTTCTTTATTTGNAAAATTAAGAGTCAGAATATAGCCT |
| 45. | hCV1824085 | rs13293506 | A/G | AAAAGAAATCCCTATCTATAAATACNATGTCTTTTCTGGTCACATCTTGCA |
| 46. | hCV1824088 | rs12000186 | C/T | CAAAGATTTCTGGGGTTATGAACGTNGGTTTTTGCAATGTTCACGAGGTTC |
| 47. | hCV2755916 | rs11788439 | A/G | TAAAACCTCATGTTCCTATATTACTNTGCTGTTAACAGAAACAGCTTGCAG |
| 48. | hCV2755908 | rs12685150 | C/G | ATGTATCAAGCACCTAGTCATTGTGNCAGATTGGGGAATCTAGGTACAAAA |

TABLE I-continued

SNP Sequences near or within the PTPRD genomic DNA.

| SEQ ID | ABI # | NCBI #: | SNP | Sequence |
|---|---|---|---|---|
| 49. | | rs2175595 | A/T | CATATGGTATTCCTAATAAAGAGATNAGATAGGAAGAACGAGAGGTATTTC |
| 50. | | rs1415723 | A/T | TTAAAGTTTCGTAAGCTTTAGACTTNATAATATCTAGGTCCGCTGCTGGGA |
| 51. | hCV2755889 | rs7041298 | C/T | CTGACCACAACTTCTCATCTATCAANTGCACACTGGTTAAGTTGGCAAGAT |
| 52. | | rs907625 | C/T | CCTCAGTTTCCCCAAATATTAACCANATTTGGTTGAAATCTTTCTGAAATA |
| 53. | hCV8781326 | rs1025547 | G/T | TTAAATGCAATCTCTTGAGTCCCATNGTTTTATCACAGAAAGGTACACTTC |
| 54. | hCV11837290 | rs10815923 | C/T | AGAGCTCAGGAATATGGCATCTTATNTGTTTTACTCCCCCTCCACTATGGA |
| 55. | hCV2755884 | rs10977243 | A/G | CACAAGTTTTCATTCAAACTAAATTNCCAGTTAAGGCTATTATCTCCTCAT |
| 56. | | rs2137346 | G/T | TTAATGCATATTTGCATGAAACATTNTATTCTTTACCAAAGCATTTTATTT |
| 57. | | rs1434265 | A/G | TAATGCCTATATTTGGCCATGAGTTNCTAGGATACAGTTTCTTTCCATGTT |
| 58. | | rs1368982 | C/T | TTTCTGAGCAATCAAATAGAAATCCNATATAGGGTAAGGAGTCAATAACAT |
| 59. | hCV2755866 | rs10815925 | C/G | ATGCACTGAAAATACAGCAATTTTANGGTAGTTCCAGCAGGGGATAATTT |
| 60. | | rs906636 | A/G | TTGATAAACATAGATGTCTAATGGCNCTTAACCTTTAAAATGTATGCAGAA |
| 61. | | rs1473822 | C/T | GGTTAAAGAATTGGTTCTAAAATGGNATCTCCATCCAATCACAGGACCTTT |
| 62. | hCV8781341 | rs1004489 | A/T | CAAAATTTCTTTATTTTTGTGGATCNTTCCGTGTTTAGAAAAATGCACAAT |
| 63. | | rs1434249 | C/G | TTGGCATGAAGAAGCAAGTGGTACANTGAAAACTTCTTGAATCCAGAAGC |
| 64. | hCV2755837 | rs6477331 | G/T | TTTCCTCCTACTCAGCTGAAGTGCANAAGAAGACCAAATTTTTTCAAATGA |
| 65. | | rs2033554 | G/T | GCCAGTAGAAACTGGCAATGAAACGNTTAAAATACAAGTCTATTCAACATG |
| 66. | | rs2033555 | C/G | TCCTTTCATCCAAAAAGACACTGTANAAGTGAGAAACAGATCTTTGTCGCA |
| 67. | hCV1058592 | rs3887368 | C/T | GTTTCTTAAACTGTCTAACAGATAANAGGCTTGATCTTTATTGTCTTCCTC |
| 68. | | rs723145 | C/T | GGAAAAAATAAAACAGTTGTCCTGTNCCTTCTTACCTCCGCTTGATTTAAG |
| | hCV249839 | ss43800463 | G/T | not available |
| | hCV8079848 | ss43852382 | A/T | not available |
| | hCV1634758 | ss43746783 | G/T | not available |
| | hCV1634732 | ss43760597 | A/G | not available |

TABLE II

Asthma associated with rs2279776 CC genotype.

| rs2279776 | CC | CG | GG |
|---|---|---|---|
| Asthma | 100 | 217 | 154 |
| Non-Asthma | 53 | 255 | 214 |

TABLE III

Asthma associated with rs767674 GG genotype.

| rs767674 | AA | AG | GG |
|---|---|---|---|
| Asthma | 108 | 211 | 152 |
| Non-Asthma | 190 | 236 | 96 |

TABLE IV

Primer Sequences

| SEQ ID NO. | Primer Sequence | Name |
|---|---|---|
| 69. | GATCCCAGGAAGTGACTATGTG | forward primer for TAQMAN ® assay |
| 70. | GGAGAGATCCCTGTGTTGCAAT | reverse primer for TAQMAN ® assay |

TABLE IV-continued

Primer Sequences

| SEQ ID NO. | Primer Sequence | Name |
|---|---|---|
| 71. | CCAACTACATAGATGGGTATAGGAAGCAAAATGC | MGB Probe-VIC ™ for allele 1 |
| 72. | CCAACTACATAGATGGCTATAGGAAGCAAAATGC | MGB-probe-FAM ™ for allele 2 |
| 73. | GTGCTCACCTGGTTGAATAACA | forward primer for SNAPSHOT ® assay |
| 74. | ATGCAACATAGGGACTCTGAGG | reverse primer for SNAPSHOT ® assay |
| 75. | ATCGATCGATCGATTGTGAATGCCAACTACATAGATGG | SNAPSHOT ® probe |

TABLE V

Polymorphic PTPRD Proteins

| SNP | Polymorphism |
|---|---|
| rs1061345 | I130M |
| rs10977171 | E447Q |
| rs7869444 | D1078E |
| rs2133788 | V1486D |

All citations are hereby expressly incorporated by reference and are listed here for convenience:

1. U.S. Pat. No. 6,713,508, Sahoo, Soumya P., et al., (2001).
2. U.S. Pat. No. 6,645,997, Sahoo, et al., (2003).
3. U.S. Pat. No. 6,569,879, Liu, et al., (2003).
4. U.S. Pat. No. 6,525,083, Acton, III, et al., (2003).
5. U.S. Pat. No. 5,858,701, White, et al., (1999).
6. U.S. Pat. No. 5,753,687, Mjalli, et al., (1998).
7. US 20040092596, Adams, Alan D., et al., (2004).
8. US 20040092583, Shanahan-Prendergast, Elizabeth, (2004).
9. US 20040073037, Jones, A. Brian, et al., (2004).
10. US 20030194745, McDowell, Robert S., et al., (2003).
11. US 20030144338, Matsumoto, Takahiro, et al., (2003).
12. US 20030143606, Olek, Alexander, et al., (2003).
13. US 20030064380, Rao, Anjana, et al., (2003).
14. US 20020183518, Mjalli, Adnan M. M., et al., (2002).
15. US 20020177166, Guthridge, Mark Andrew, et al., (2002).
16. US 20020173663, Liu, Kun, et al., (2002).
17. US 20020150947, Erlanson, Daniel A., et al., (2002).
18. US 20020103242, Sahoo, Soumya P., et al., (2002).
19. US 20020042441, Acton, John J. III, et al., (2002).
20. US 20040029123, Olek, Alexander, et al., (2004).
21. US 20030170660, Sondergaard, Helle Bach, et al., (2003).
22. US 20030143606, Olek, Alexander, et al., (2003).
23. US 20030104404, Wise, Carol A., (2003).
24. U.S. Pat. No. 5,821,075, Gonez, et al., (1998).
25. Huihsduijnen, et al., DDT 7:1013-1019 (2002).
26. Lander, et al., *Genomics* 1:174-181 (1987).
27. Mustelin, et al., Nature Rev. Immun.: 43-57 (2005).
28. Wang, et al., J. Hum. Genet. 50:249-258 (2005).
29. Zhang, et al., Chem. Biol. 5:416-423 (2001).

SEQUENCE LISTING (84 sequences)

SEQ ID NO: 1 - DNA, 51 bp, Homo sapiens
  misc_feature (26)..(26): n is a, c, g, or t
tgtgtgtgtcatgattctagattgtnctaacctatccagcaagttcaaaac

SEQ ID NO: 2 - DNA, 51 bp, Homo sapiens
  misc_feature (26)..(26): n is a, c, g, or t
cccagacaagtgttttccaagtagtntcaaaccattaccaccaattgaaca

SEQ ID NO: 3 - DNA, 51 bp, Homo sapiens
  misc_feature (26)..(26): n is a, c, g, or t
aattcatagctcttgtgcacttaagnaggaaagcaatgggaagttcagata

SEQ ID NO: 4 - DNA, 51 bp, Homo sapiens
  misc_feature (26)..(26): n is a, c, g, or t
aaggatgctagaagggactttaaacntcagctaagataactgaagtccaga

SEQ ID NO: 5 - DNA, 51 bp, Homo sapiens
  misc_feature (26)..(26): n is a, c, g, or t
tcctgactgatgttatttggggatgnagataaacaggaagatgacaccaag

SEQ ID NO: 6 - DNA, 51 bp, Homo sapiens
  misc_feature (26)..(26): n is a, c, g, or t
gctttcattcaaacataacatctggnagctcaaccttggggatgcacttgg

SEQ ID NO: 7 - DNA, 51 bp, Homo sapiens
  misc_feature (26)..(26): n is a, c, g, or t
actctgtaatcattttgaaacttcangctataaaagacttcagatgtagaa

SEQ ID NO: 8 - DNA, 51 bp, Homo sapiens
  misc_feature (26)..(26): n is a, c, g, or t
ggccagaatatagcaatgtggtatgnaatcagaaaggaaggagtggctcat

SEQ ID NO: 9 - DNA, 51 bp, Homo sapiens
  misc_feature (26)..(26): n is a, c, g, or t
gacaaatatttgcgcaggaagacaanattcttaggtgagaagcattatatt

SEQ ID NO: 10 - DNA, 51 bp, Homo sapiens
  misc_feature (26)..(26): n is a, c, g, or t
aaatggctgagtgataatggaagatntatttcattcttcactgttgccatt

SEQ ID NO: 11 - DNA, 51 bp, Homo sapiens
  misc_feature (26)..(26): n is a, c, g, or t
ttctaattcacagcagcatttacaanacgcacacatattttcttcatgtac

SEQ ID NO: 12 - DNA, 51 bp, Homo sapiens
  misc_feature (26)..(26): n is a, c, g, or t
caatataggcattttgcttcctatanccatctatgtagttggcattcacat

SEQ ID NO: 13 - DNA, 51 bp, Homo sapiens
  misc_feature (26)..(26): n is a, c, g, or t
catttcaggtaagttctctctcacanatcctctgcaaatgtggagataaga

SEQ ID NO: 14 - DNA, 51 bp, Homo sapiens
  misc_feature (26)..(26): n is a, c, g, or t
tccatttatcaagcaccagtgttttnttttgcattacagagtacttcaaat

SEQ ID NO: 15 - DNA, 51 bp, Homo sapiens
  misc_feature (26)..(26): n is a, c, g, or t
cttttccacccatgctaagtgacttnagacactgtcacatcctgcaccggt

SEQ ID NO: 16 - DNA, 51 bp, Homo sapiens
  misc_feature (26)..(26): n is a, c, g, or t
gaagaagcccaacttaagaaacacanctacacatcactatcctttatttca

SEQ ID NO: 17 - DNA, 51 bp, Homo sapiens
  misc_feature (26)..(26): n is a, c, g, or t
gcagcttttgactaaacctttctaangctaacaacagatcttcaactcaaa

SEQ ID NO: 18 - DNA, 51 bp, Homo sapiens
  misc_feature (26)..(26): n is a, c, g, or t
gtcagttagtaggagagaaagcaagncacagacatgcagacaatggagggc

SEQ ID NO: 19 - DNA, 51 bp, Homo sapiens
  misc_feature (26)..(26): n is a, c, g, or t
accctccatccttgtcaccctttacnttcccctaattgctttcatagagct

SEQ ID NO: 20 - DNA, 51 bp, Homo sapiens
  misc_feature (26)..(26): n is a, c, g, or t
aaagaatgacatgcaccacgactcantgacgataatcactgacggcacaat

SEQ ID NO: 21 - DNA, 51 bp, Homo sapiens
  misc_feature (26)..(26): n is a, c, g, or t
tggtctggaagtattatattggaagnttattaaagaaaaattcaagcagac

SEQ ID NO: 22 - DNA, 51 bp, Homo sapiens
  misc_feature (26)..(26): n is a, c, g, or t
tgaggaatctgatcccataccccgtncactctcatttagcacatttcacat

SEQ ID NO: 23 - DNA, 51 bp, Homo sapiens
  misc_feature (26)..(26): n is a, c, g, or t
tttttaagatgccaagttatcctaangcctaggataatcgggaccaggtaa

SEQ ID NO: 24 - DNA, 51 bp, Homo sapiens
  misc_feature (26)..(26): n is a, c, g, or t
taaaggtcagcctcaccatacacctnggtacatatgtggtacaaatatcta

SEQ ID NO: 25 - DNA, 51 bp, Homo sapiens
  misc_feature (26)..(26): n is a, c, g, or t
ttaaaacttttatctctggctctctnaattttgaattaaaccagtcccatc

SEQ ID NO: 26 - DNA, 51 bp, Homo sapiens
  misc_feature (26)..(26): n is a, c, g, or t
ttttacaaggagcaaggggcaaaatnttaaggccaacaaagattagacagg

SEQ ID NO: 27 - DNA, 51 bp, Homo sapiens
  misc_feature (26)..(26): n is a, c, g, or t
ttagcccacataaatacctagtagtnctgttgtttatacaaacctaaaatg

SEQ ID NO: 28 - DNA, 51 bp, Homo sapiens
  misc_feature (26)..(26): n is a, c, g, or t
tgccaaccacggcaagtgacacagcntggcacggagcttcttgtaatacct

SEQ ID NO: 29 - DNA, 51 bp, Homo sapiens
  misc_feature (26)..(26): n is a, c, g, or t
atacctgaccgtgttacattaaccantctagaaaacaggagtagtaacctt

SEQ ID NO: 30 - DNA, 51 bp, Homo sapiens
  misc_feature (26)..(26): n is a, c, g, or t
tttgtcatttatgagcatgttcttantaactgatgtttcactttataatat

SEQ ID NO: 31 - DNA, 51 bp, Homo sapiens
  misc_feature (26)..(26): n is a, c, g, or t
tacatagaggtatgttcctaaaaagntatttgagaagtgattcgggcagag

SEQ ID NO: 32 - DNA, 51 bp, Homo sapiens
  misc_feature (26)..(26): n is a, c, g, or t
ttgttttagcacagaagaaagtagantccatcagcaaaattgcagtttaga

SEQ ID NO: 33 - DNA, 51 bp, Homo sapiens
  misc_feature (26)..(26): n is a, c, g, or t
aactcctgactcaaaccaaaccggantacagtatggtcaagaattagaaac

SEQ ID NO: 34 - DNA, 51 bp, Homo sapiens
  misc_feature (26)..(26): n is a, c, g, or t
aacctccaggaactcctgtagtgacngagagcacagctacaagcatcacac

SEQ ID NO: 35 - DNA, 51 bp, Homo sapiens
  misc_feature (26)..(26): n is a, c, g, or t
atataacattatttcacgattgtaantgttgacaatgtgtacctttgttct

SEQ ID NO: 36 - DNA, 51 bp, Homo sapiens
  misc_feature (26)..(26): n is a, c, g, or t
gtcccaccataatggtcgaccatgtntaaaattcctagttctgtctggtta

SEQ ID NO: 37 - DNA, 51 bp, Homo sapiens
  misc_feature (26)..(26): n is a, c, g, or t
cattagtcacttggcttgagtgtacncagatcctcaaagcataatccattg

SEQ ID NO: 38 - DNA, 51 bp, Homo sapiens
  misc_feature (26)..(26): n is a, c, g, or t
taatggctaaaaaagcccaggagtgnaccactcagtttttttgttgaggca

SEQ ID NO: 39 - DNA, 51 bp, Homo sapiens
  misc_feature (26)..(26): n is a, c, g, or t
ttttgtgattcataatcaaataaacncattgagaaaaaaaagaagtacctt

SEQ ID NO: 40 - DNA, 51 bp, Homo sapiens
  misc_feature (26)..(26): n is a, c, g, or t
cagtcatgtcttcccttgggaagcantgtcatgtatttgaggcactcatga

SEQ ID NO: 41 - DNA, 51 bp, Homo sapiens
  misc_feature (26)..(26): n is a, c, g, or t
cccttccttaagtgactttaacctcngtaggcattgggccccatgacccat

SEQ ID NO: 42 - DNA, 51 bp, Homo sapiens
  misc_feature (26)..(26): n is a, c, g, or t
acggaaacaaatgtaactgatacatntgaagcaagaggagattgaagatga

SEQ ID NO: 43 - DNA, 51 bp, Homo sapiens
  misc_feature (26)..(26): n is a, c, g, or t
acgcttatcaaaaagaactggggtangttattcatcaaagttttatcatta

SEQ ID NO: 44 - DNA, 51 bp, Homo sapiens
  misc_feature (26)..(26): n is a, c, g, or t
ctttccattttagtttctttatttgnaaaattaagagtcagaatatagcct

SEQ ID NO: 45 - DNA, 51 bp, Homo sapiens
  misc_feature (26)..(26): n is a, c, g, or t
aaaagaaatccctatctataaatacnatgtcttttctggtcacatcttgca

SEQ ID NO: 46 - DNA, 51 bp, Homo sapiens
  misc_feature (26)..(26): n is a, c, g, or t
caaagatttctggggttatgaacgtnggtttttgcaatgttcacgaggttc

SEQ ID NO: 47 - DNA, 51 bp, Homo sapiens
  misc_feature (26)..(26): n is a, c, g, or t
taaaacctcatgttcctatattactntgctgttaacagaaacagcttgcag

SEQ ID NO: 48 - DNA, 51 bp, Homo sapiens
  misc_feature (26)..(26): n is a, c, g, or t
atgtatcaagcacctagtcattgtgncagattggggaatctaggtacaaaa

SEQ ID NO: 49 - DNA, 51 bp, Homo sapiens
  misc_feature (26)..(26): n is a, c, g, or t
catatggtattcctaataaagagatnagataggaagaacgagaggtatttc

SEQ ID NO: 50 - DNA, 51 bp, Homo sapiens
  misc_feature (26)..(26): n is a, c, g, or t
ttaaagtttcgtaagctttagacttnataatatctaggtccgctgctggga

SEQ ID NO: 51 - DNA, 51 bp, Homo sapiens
  misc_feature (26)..(26): n is a, c, g, or t
ctgaccacaacttctcatctatcaantgcacactggttaagttggcaagat

SEQ ID NO: 52 - DNA, 51 bp, Homo sapiens
  misc_feature (26)..(26): n is a, c, g, or t
cctcagtttccccaaatattaaccanatttggttgaaatctttctgaaata

SEQ ID NO: 53 - DNA, 51 bp, Homo sapiens
  misc_feature (26)..(26): n is a, c, g, or t
ttaaatgcaatctcttgagtcccatngttttatcacagaaaggtacacttc

SEQ ID NO: 54 - DNA, 51 bp, Homo sapiens
  misc_feature (26)..(26): n is a, c, g, or t
agagctcaggaatatggcatcttatntgttttactccccctccactatgga

SEQ ID NO: 55 - DNA, 51 bp, Homo sapiens
  misc_feature (26)..(26): n is a, c, g, or t
cacaagttttcattcaaactaaattnccagttaaggctattatctcctcat

SEQ ID NO: 56 - DNA, 51 bp, Homo sapiens
  misc_feature (26)..(26): n is a, c, g, or t
ttaatgcatatttgcatgaaacattntattctttaccaaagcattttattt

SEQ ID NO: 57 - DNA, 51 bp, Homo sapiens
  misc_feature (26)..(26): n is a, c, g, or t
taatgcctatatttggccatgagttnctaggatacagtttctttccatgtt

SEQ ID NO: 58 - DNA, 51 bp, Homo sapiens
  misc_feature (26)..(26): n is a, c, g, or t
tttctgagcaatcaaatagaaatccnatatagggtaaggagtcaataacat

SEQ ID NO: 59 - DNA, 51 bp, Homo sapiens
  misc_feature (26)..(26): n is a, c, g, or t
atgcactgaaaatacagcaattttanaggtagttccagcaggggataattt

SEQ ID NO: 60 - DNA, 51 bp, Homo sapiens
  misc_feature (26)..(26): n is a, c, g, or t
ttgataaacatagatgtctaatggcncttaacctttaaaatgtatgcagaa

SEQ ID NO: 61 - DNA, 51 bp, Homo sapiens
  misc_feature (26)..(26): n is a, c, g, or t
ggttaaagaattggttctaaaatggnatctccatccaatcacaggaccttt

SEQ ID NO: 62 - DNA, 51 bp, Homo sapiens
  misc_feature (26)..(26): n is a, c, g, or t
caaaatttctttatttttgtggatcnttccgtgtttagaaaaatgcacaat

SEQ ID NO: 63 - DNA, 51 bp, Homo sapiens
  misc_feature (26)..(26): n is a, c, g, or t
ttggcatgaagaagcaagtggtacantggaaaacttcttgaatccagaagc

SEQ ID NO: 64 - DNA, 51 bp, Homo sapiens
  misc_feature (26)..(26): n is a, c, g, or t
tttcctcctactcagctgaagtgcanaagaagaccaaattttttcaaatga

SEQ ID NO: 65 - DNA, 51 bp, Homo sapiens
  misc_feature (26)..(26): n is a, c, g, or t
gccagtagaaactggcaatgaaacgnttaaaatacaagtctattcaacatg

SEQ ID NO: 66 - DNA, 51 bp, Homo sapiens
  misc_feature (26)..(26): n is a, c, g, or t
tcctttcatccaaaaagacactgtanaagtgagaaacagatctttctcgca

SEQ ID NO: 67 - DNA, 51 bp, Homo sapiens
  misc_feature (26)..(26): n is a, c, g, or t
ggaaaaaataaaacagttgtcctgtnccttcttacctccgcttgatttaag

SEQ ID NO: 68 - DNA, 51 bp, Homo sapiens
  misc_feature (26)..(26): n is a, c, g, or t
gtttcttaaactgtctaacagataanaggcttgatctttattgtcttcctc

SEQ ID NO: 69 - DNA, 22 bp, Homo sapiens
gatcccaggaagtgactatgtg

SEQ ID NO: 70 - DNA, 22 bp, Homo sapiens
ggagagatccctgtgttgcaat

SEQ ID NO: 71 - DNA, 34 bp, Homo sapiens
ccaactacatagatgggtataggaagcaaaatgc

SEQ ID NO: 72 - DNA, 34 bp, Homo sapiens
ccaactacatagatggctataggaagcaaaatgc

SEQ ID NO: 73 - DNA, 22 bp, Homo sapiens
gtgctcacctggttgaataaca

SEQ ID NO: 74 - DNA, 22 bp, Homo sapiens
atgcaacatagggactctgagg

SEQ ID NO: 75 - DNA, 38 bp, Homo sapiens
atcgatcgatcgattgtgaatgccaactacatagatgg

SEQ ID NO: 76 - protein, 1912 aa, Homo sapiens
MVHVARLLLLLLTFFLRTDAETPPRFTRTPVDQTGVSGGVASFICQATGDPRPKIVWNKKGKKVSNQRFEVIEFDDGSGSVLRIQPLRTPRDEAIYECVASNNVGEISVSTRLTVLREDQIPRGFPTIDMGPQLKVVERTRTATMLCAASGNPDPEITWFKDFLPVDTSNNNGRIKQLRSESIGGTPIRGALQIEQSEESDQGKYECVATNSAGTRYSAPANLYVRELREVRRVPPRFSIPPTNHEIMPGGSVNITCVAVGSPMPYVKWMLGAEDLTPEDDMPIGRNVLELNDVRQSANYTCVAMSTLGVIEAIAQITVKALPKPPGTPVVTESTATSITLTWDSGNPEPVSYYIIQHKPKNSEELYKEIDGVATTRYSVAGLSPYSDYEFRVVAVNNIGRGPPSEPVLTQTSEQAPSSAPRDVQARMLSSTTILVQWKEPEEPNGQIQGYRVYYTMDPTQHVNNWMKHNVADSQITTIGNLVPQKTYSVKVLAFTSIGDGPLSSDIQVITQTGVPGQPLNFKAEPESETSILLSWTPPRSDTIANYELVYKDGEHGEEQRITIEPGTSYRLQGLKPNSLYYFRLAARSPQGLGASTAEISARTMQSKPSAPPQDISCTSPSSTSILVSWQPPPVEKQNGIITEYSIKYTAVDGEDDKPHEILGIPSDTTKYLLEQLEKWTEYRITVTAHTDVGPGPESLSVLIRTNEDVPSGPPRKVEVEAVNSTSVKVSWRSPVPNKQHGQIRGYQVHYVRMENGEPKGQPMLKDVMLADAQWEFDDTTEHDMIISGLQPETSYSLTVTAYTTKGDGARSKPKLVSTTGAVPGKPRLVINHTQMNTALIQWHPPVDTFGPLQGYRLKFGRKDMEPLTTLEFSEKEDHFTATDIHKGASYVFRLSARNKVGFGEEMVKEISIPEEVPTGFPQNLHSEGTTSTSVQLSWQPPVLAERNGIITKYTLLYRDINIPLLPMEQLIVPADTTMTLTGLKPDTTYDVKVRAHTSKGPGPYSPSVQFRTLPVDQVFAKNFHVKAVMKTSVLLSWEIPENYNSAMPFKILYDDGKMVEEVDGRATQKLIVNLKPEKSYSFVLTNRGNSAGGLQHRVTAKTAPDVLRTKPAFIGKTNLDGMITVQLPEVPANENIKGYYIIIVPLKKSRGKFIKPWESPDEMELDELLKEISRKRRSIRYGREVELKPYIAAHFDVLPTEFTLGDDKHYGGFTNKQLQSGQEYVFFVLAVMEHAESKMYATSPYSDPVVSMDLDPQPITDEEEGLIWVVGPVLAVVFIICIVIAILLYKRKRAESDSRKSSIPNNKEIPSHHPTDPVELRRLNFQTPGMASHPPIPILELADHIERLKANDNLKFSQEYESIDPGQQFTWEHSNLEVNKPKNRYANVIAYDHSRVLLSAIEGIPGSDYVNANYIDGYRKQNAYIATQGSLPETFGDFWRMIWEQRSATVVMMTKLEERSRVKCDQYWPSRGTETHGLVQVTLLDTVELATYCVRTFALYKNGSSEKREVRQFQFTAWPDHGVPEHPTPFLAFLRRVKTCNPPDAGPMVVHCSAGVGRTGCFIVIDAMLERIKHEKTVDIYGHVTLMRAQRNYMVQTEDQYIFIHDALLEAVTCGNTEVPARNLYAYIQKLTQIETGENVTGMELEFKRLASSKAHTSRFISANLPCNKFKNRLVNIMPYESTRVCLQPIRGVEGSDYINASFIDGYRQQKAYIATQGPLAETTEDFWRMLWEHNSTIVVMLTKLREMGREKCHQYWPAERSARYQYFVVDPMAEYNMPQYILREFKVTDARDGQSRTVRQFQFTDWPEQGVPKSGEGFIDFIGQVHKTKEQFGQDGPISVHCSAGVGRTGVFITLSIVLERMRYEGVVDIFQTVKMLRTQRPAMVQTEDQYQFSYRAALEYLGSFDHYAT

SEQ ID NO: 77 - protein, 1899 aa, Homo sapiens
MVHVARLLLLLLTFFLRTDAETPPRFTRTPVDQTGVSGGVASFICQATGDPRPKIVWNKKGKKVSNQRFEVIEFDDGSGSVLRIQPLRTPRDEAIYECVASNNVGEISVSTRLTVLREDQIPRGFPTIDMGPQLKVVERTRTATMLCAASGNPDPEITWFKDFLPVDTSNNNGRIKQLRSGALQIEQSEESDQGKYECVATNSAGTRYSAPANLYVRVRRVPPRFSIPPTNHEIMPGGSVNITCVAVGSPMPYVKWMLGAEDLTPEDDMPIGRNVLELNDVRQSANYTCVAMSTLGVIEAIAQITVKALPKPPGTPVVTESTATSITLTWDSGNPEPVSYYIIQHKPKNSEELYKEIDGVATTRYSVAGLSPYSDYEFRVVAVNNIGRGPPSEPVLTQTSEQAPSSAPRDVQARMLSSTTILVQWKEPEEPNGQIQGYRVYYTMDPTQHVNNWMKHNVADSQITTIGNLVPQKTYSVKVLAFTSIGDGPLSSDIQVITQTGVPGQPLNFKAEPESETSILLSWTPPRSDTIANYELVYKDGEHGEEQRITIEPGTSYRLQGLKPNSLYYFRLAARSPQGLGASTAEISARTMQSKPSAPPQDISCTSPSSTSILVSWQPPPVEKQNGIITEYSIKYTAVDGEDDKPHEILGIPSDTTKYLLEQLEKWTEYRITVTAHTDVGPGPESLSVLIRTNEDVPSGPPRKVEVEAVNSTSVKVSWRSPVPNKQHGQIRGYQVHYVRMENGEPKGQPMLKDVMLADAQWEFDDTTEHDMIISGLQPETSYSLTVTAYTTKGDGARSKPKLVSTTGAVPGKPRLVINHTQMNTALIQWHPPVDTFGPLQGYRLKFGRKDMEPLTTLEFSEKEDHFTATDIHKGASYVFRLSARNKVGFGEEMVKEISIPEEVPTGFPQNLHSEGTTSTSVQLSWQPPVLAERNGIITKYTLLYRDINIPLLPMEQLIVPADTTMTLTGLKPDTTYDVKVRAHTSKGPGPYSPSVQFRTLPVDQVFAKNFHVKAVMKTSVLLSWEIPENYNSAMPFKILYDDGKMVEEVDGRATQKLIVNLKPEKSYSFVLTNRGNSAGGLQHRVTAKTAPDVLRTKPAFIGKTNLDGMITVQLPEVPANENIKGYYIIIVPLKKSRGKFIKPWESPDEMELDELLKEISRKRRSIRYGREVELKPYIAAHFDVLPTEFTLGDDKHYGGFTNKQLQSGQEYVFFVLAVMEHAESKMYATSPYSDPVVSMDLDPQPITDEEEGLIWVVGPVLAVVFIICIVIAILLYKRKRAESDSRKSSIPNNKEIPSHHPTDPVELRRLNFQTPGMASHPPIPILELADHIERLKANDNLKFSQEYESIDPGQQFTWEHSNLEVNKPKNRYANVIAYDHSRVLLSAIEGIPGSDYVNANYIDGYRKQNAYIATQGSLPETFGDFWRMIWEQRSATVVMMTKLEERSRVKCDQYWPSRGTETHGLVQVTLLDTVELATYCVRTFALYKNGSSEKREVRQFQFTAWPDHGVPEHPTPFLAFLRRVKTCNPPDAGPMVVHCSAGVGRTGCFIVIDAMLERIKHEKTVDIYGHVTLMRAQRNYMVQTEDQYIFIHDALLEAVTCGNTEVPARNLYAYIQKLTQIETGENVTGMELEFKRLASSKAHTSRFISANLPCNKFKNRLVNIMPYESTRVCLQPIRGVEGSDYINASFIDGYRQQKAYIATQGPLAETTEDFWRMLWEHNSTIVVMLTKLREMGREKCHQYWPAERSARYQYFVVDPMAEYNMPQYILREFKVTDARDGQSRTVRQFQFTDWPEQGVPKSGEGFIDFIGQVHKTKEQFGQDGPISVHCSAGVGRTGVFITLSIVLERMRYEGVVDIFQTVKMLRTQRPAMVQTEDQYQFSYRAALEYLGSFDHYAT

SEQ ID NO: 78 - protein, 1903 aa, Homo sapiens
MVHVARLLLLLLTFFLRTDAETPPRFTRTPVDQTGVSGGVASFICQATGDPRPKIVWNKKGKKVSNQRFEVIEFDDGSGSVLRIQPLRTPRDEAIYECVASNNVGEISVSTRLTVLREDQIPRGFPTIDMGPQLKVVERTRTATMLCAASGNPDPEITWFKDFLPVDTSNNNGRIKQLRSESIGGTPIRGALQIEQSEESDQGKYECVATNSAGTRYSAPANLYVRELREVRRVPPRFSIPPTNHEIMPGGSVNITCVAVGSPMPYVKWMLGAEDLTPEDDMPIGRNVLELNDVRQSANYTCVAMSTLGVIEAIAQITVKALPKPPGTPVVTESTATSITLTWDSGNPEPVSYYIIQHKPKNSEELYKEIDGVATTRYSVAGLSPYSDYEFRVVAVNNIGRGPPSEPVLTQTSEQAPSSAPRDVQARMLSSTTILVQWKEPEEPNGQIQGYRVYYTMDPTQHVNNWMKHNVADSQITTIGNLVPQKTYSVKVLAFTSIGDGPLSSDIQVITQTGVPGQPLNFKAEPESETSILLSWTPPRSDTIANYELVYKDGEHGEEQRITIEPGTSYRLQGLKPNSLYYFRLAARSPQGLGASTAEISARTMQSKPSAPPQDISCTSPSSTSILVSWQPPPVEKQNGIITEYSIKYTAVDGEDDKPHEILGIPSDTTKYLLEQLEKWTEYRITVTAHTDVGPGPESLSVLIRTNEDVPSGPPRKVEVEAVNSTSVKVSWRSPVPNKQHGQIRGYQVHYVRMENGEPKGQPMLKDVMLADAQDMIISGLQPETSYSLTVTAYTTKGDGARSKPKLVSTTGAVPGKPRLVINHTQMNTALIQWHPPVDTFGPLQGYRLKFGRKDMEPLTTLEFSEKEDHFTATDIHKGASYVFRLSARNKVGFGEEMVKEISIPEEVPTGFPQNLHSEGTTSTSVQLSWQPPVLAERNGIITKYTLLYRDINIPLLPMEQLIVPADTTMTLTGLKPDTTYDVKVRAHTSKGPGPYSPSVQFRTLPVDQVFAKNFHVKAVMKTSVLLSWEIPENYNSAMPFKILYDDGKMVEEVDGRATQKLIVNLKPEKSYSFVLTNRGNSAGGLQHRVTAKTAPDVLRTKPAFIGKTNLDGMITVQLPEVPANENIKGYYIIIVPLKKSRGKFIKPWESPDEMELDELLKEISRKRRSIRYGREVELKPYIAAHFDVLPTEFTLGDDKHYGGFTNKQLQSGQEYVFFVLAVMEHAESKMYATSPYSDPVVSMDLDPQPITDEEEGLIWVVGPVLAVVFIICIVIAILLYKRKRAESDSRKSSIPNNKEIPSHHPTDPVELRRLNFQTPGMASHPPIPILELADHIERLKANDNLKFSQEYESIDPGQQFTWEHSNLEVNKPKNRYANVIAYDHSRVLLSAIEGIPGSDYVNANYIDGYRKQNAYIATQGSLPETFGDFWRMIWEQRSATVVMMTKLEERSRVKCDQYWPSRGTETHGLVQVTLLDTVELATYCVRTFALYKNGSSEKREVRQFQFTAWPDHGVPEHPTPFLAFLRRVKTCNPPDAGPMVVHCSAGVGRTGCFIVIDAMLERIKHEKTVDIYGHVTLMRAQRNYMVQTEDQYIFIHDALLEAVTCGNTEVPARNLYAYIQKLTQIETGENVTGMELEFKRLASSKAHTSRFISANLPCNKFKNRLVNIMPYESTRVCLQPIRGVEGSDYINASFIDGYRQQKAYIATQGPLAETTEDFWRMLWEHNSTIVVMLTKLREMGREKCHQYWPAERSARYQYFVVDPMAEYNMPQYILREFKVTDARDGQSRTVRQFQFTDWPEQGVPKSGEGFIDFIGQVHKTKEQFGQDGPISVHCSAGVGRTGVFITLSIVLERMRYEGVVDIFQTVKMLRTQRPAMVQTEDQYQFSYRAALEYLGSFDHYAT

SEQ ID NO: 79 - protein, 1501 aa, Homo sapiens
MVHVARLLLLLLTFFLRTDAETPPRFTRTPVDQTGVSGGVASFICQATGDPRPKIVWNKKGKKVSNQRFEVIEFDDGSGSVLRIQPLRTPRDEAIYECVASNNVGEISVSTRLTVLREDQIPRGFPTIDMGPQLKVVERTRTATMLCAASGNPDPEITWFKDFLPVDTSNNNGRIKQLRSESIGGTPIRGALQIEQSEESDQGKYECVATNSAGTRYSAPANLYVRELREVRRVPPRFSIPPTNHEIMPGGSVNITCVAVGSPMPYVKWMLGAEDLTPEDDMPIGRNVLELNDVRQSANYTCVAMSTLGVIEAIAQITVKALPKPPGTPVVTESTATSITLTWDSGNPEPVSYYIIQHKPKNSEELYKEIDGVATTRYSVAGLSPYSDYEFRVVAVNNIGRGPPSEPVLTQTSEQAPSSAPRDVQARMLSSTTILVQWKEPEEPNGQIQGYRVYYTMDPTQHVNNWMKHNVADSQITTIGNLVPQKTYSVKVLAFTSIGDGPLSSDIQVITQTGVPGQPLNFKAEPESETSILLSWTPPRSDTIANYELVYKDGEHGEEQRITIEPGTSYRLQGLKPNSLYYFRLAARSPQGLGASTAEISARTMQSMFAKNFHVKAVMKTSVLLSWEIPENYNSAMPFKILYDDGKMVEEVDGRATQKLIVNLKPEKSYSFVLTNRGNSAGGLQHRVTAKTAPDVLRTKPAFIGKTNLDGMITVQLPEVPANENIKGYYIIIVPLKKSRGKFIKPWESPDEMELDELLKEISRKRRSIRYGREVELKPYIAAHFDVLPTEFTLGDDKHYGGFTNKQLQSGQEYVFFVLAVMEHAESKMYATSPYSDPVVSMDLDPQPITDEEEGLIWVVGPVLAVVFIICIVIAILLYKRKRAESDSRKSSIPNNKEIPSHHPTDPVELRRLNFQTPGMASHPPIPILELADHIERLKANDNLKFSQEYESIDPGQQFTWEHSNLEVNKPKNRYANVIAYDHSRVLLSAIEGIPGSDYVNANYIDGYRKQNAYIATQGSLPETFGDFWRMIWEQRSATVVMMTKLEERSRVKCDQYWPSRGTETHGLVQVTLLDTVELATYCVRTFALYKNGSSEKREVRQFQFTAWPDHGVPEHPTPFLAFLRRVKTCNPPDAGPMVVHCSAGVGRTGCFIVIDAMLERIKHEKTVDIYGHVTLMRAQRNYMVQTEDQYIFIHDALLEAVTCGNTEVPARNLYAYIQKLTQIETGENVTGMELEFKRLASSKAHTSRFISANLPCNKFKNRLVNIMPYESTRVCLQPIRGVEGSDYINASFIDGYRQQKAYIATQGPLAETTEDFWRMLWEHNSTIVVMLTKLREMGREKCHQYWPAERSARYQYFVVDPMAEYNMPQYILREFKVTDARDGQSRTVRQFQFTDWPEQGVPKSGEGFIDFIGQVHKTKEQFGQDGPISVHCSAGVGRTGVFITLSIVLERMRYEGVVDIFQTVKMLRTQRPAMVQTEDQYQFSYRAALEYLGSFDHYAT

SEQ ID NO: 80 - DNA, 92384 bp, Homo sapiens
gaattcacaaaaatgctacttcgtcgtattttttgtgtctccagccaatcaaaaagcctcttgaaagacagatattggatgaaccccatatagcgtctaaagttttaccaagatgccgcaccattttacattgcttccctgcctgcacactgggcacttgactcctcctccccaccgcagcttttgactaaacctttctaacgctaacaacagatcttcaactcaaaggctttgcttactcagaaaaaatgacccaatagaagaaaaaatcctattgtgagtgatttaaagaacaacgggaaagtctcaagcagatacttgctaatataaaacactttgcatttatttagtctttaacttgatggtctgaaagttctaatcctttttatttgatcaactagaagtttatctcaaactaggtaactgaaaaaataagctatagcagatggattagaggtttgcattgtattctcgacaaaaactcagaattaaaatataaatatatccaatagttgtaactaatacttagataacatttactatgttttctttgtgctttgtacatactaactcatttatcttcacaaagaccctagaagtagttgccattatgattacagttatgtagatgaggaaactgaggtatagataagacaaataactttctcagggtcaaacagctagcagggagagaggccaggctgggggtccacatattctggccctggaggctgagggcccagccaccataagatgctttctctctagttaagctggagaagattccttgaaggtttcacacttgcctttcaactattctcttgaaacacaacgcacagaaggttgggaacaatctgtgtagtactgctgaactctatttgtaattctaaactccaaacaagagagtgatcatcaatttgcacatcagattacagtcaccaagtaaaattatatcctgatatgggagtaacctttttcaataatgctgaagtcattatcttaaagcaaagtcctttaatcattctgcaaaattcaacctttttacccagaagaaaaatataattcaaatgtgcaaaacaccatacaatactagttgctctgtgtttcactttccctcatcccgccaagagaaaaacctcaaaatattccctttagaaactcatcaaagagaaaccacaaaaaaagatcatcctgtttttgtgtgtttttaaaacaactaacaaaaatttaattatatagaaggaatagaccagttacttcactcgtcaaaccatgggtcagactaaccattctttttacagggaattgaactttcaatgaccttaacttccaaagaaacagtatcttttcacatatctccccttcagtaggctcatttggttcttagtgtggttggctctgagatattctcaagtcctttctgaggtttagaagagcaatctaccattcactgtgtattctgcaattatgccttttaaaattctcattcattgtctctctcttctctgtttgaaaatggtaaattaatatatgcccatttggaaaagaccacgtttgcatagatgggaagggctatattttgcacaattagtaaaagcctgcaattggcataatgaatactttcttcaaagagaagagcatgagttcagttgaatcctatgatgttttagaaactgaaatgtgaggaaggagtggaaagtccagtggtgaacaaaatctggaagtcagagaacagggtgttagctttctggctgcccctggttagctctggccggtcaggtaacttgggtctgtttgctctgtgttcccttttcctcttaatgtcaacctagtgtcaggtgtgtgtcctcattttctcttatctctctttgtccaattagttatcaaatcttactgagtctctctctgtaagagcacctctgatccaggccaacattagagtgtgaaggattgaaataaagatttttcaagactctcagtattaacaaatgaatggatgtgggagtgccccacctttagtagtagaaaaggcatagaaaatgtataaatataccacactcattgaagtcatcaaaaagtgtttcagtcacatatttttgtacacagttaaaattctggcttcagataagtgataaaatgcatcagctttacctgttgtctaatggttgcatttgaaattttgactctaacatactatataacaaatacgtatagaaaattacttaaagtaataatatatattattagaactgacatgcagggaacaaaaaggataaactatgctcatagtaaatcattcatccatggcaagtgagtaaatatctgaggtaaacttttgataaacaatttattctaaattatatcatagtactaaagatgaattagtttatttcactgaggaaaccattgattcccagaagtatattagaattatcttaatctaacgtggattaaaaatgatgaaaaacaacaacaaaaccaaaaatacttaattcttttttttaactcagtaggccaacatgaggtactctctagaattcagataaagtgttttactattttagtgtgtgactgtagaaaagattatttttgagagatcgttccaaataagaatccaaaaaagaacatacaactttaagattaaagatttaaataactagattttttactatatacttttttaaaattttttatttatcttttatttttatttttattttttttgtggcagggtcatgcctgtccaggctgaagtgcaatggcgtgatcttggctcactgcaacctctgcctcccgggttcaagcaattctcctgcctcagcctcccaagtagctgggattacaggcatgtgtcaccatgcctggctaacttttgtatttttagtagaggcagggtttcgccatgttggccaggctagtctcgaactcatgaccttaagtgatccacctgccttggcttcccaaagtgttgaggttacaggcgtgagtcactacacccaacactatacatggctttttaatatgccaaacattttcctgaatattactaaatgcagaagaaagacatttctagtttccaaagacaatgtgctagaggaataagatcagcgatatgtgttaatcctaatgttttcatttttagctatttatctcctacatcagataaggtgaataataagaaagagatggacagatttataggtgatgttctttttttatttcttcacatctttgaattctatatagttgatgttcttaagaatagaatgtgtcattggaaatcactttacaaatacaattcacagattagaatttctgatgttatttgaaaaagcaaagagtattaaagaatttccaggcagtttggggcaagcaaatgtattagaaagttattaaactgctttgtttaaatagacaatgttgactgaattggtaaaatgtaattacgatgacttataagaagaagtcacttgatctgcaaatcacttataaagtatgatatttaataattaaagaggatcctggtgaggtggcatgtgcctgtaatcccacctactctactcaggatgctgaggcaggaagacttcttgagccctggagtttgagtccagcctgggcaacacagcaagacccaatctcattaaacaaaatattaaaataggttatgcacacctagaaacattaaagagtatggcaacattaaagagaatattattgagtataggtaacagacaaaattatctagcaaatacaatcaatgtgcagcattaaacactaatttacggtgttagtaaattagtgttttagtaaattaggaagaattaattcacagctgcatcctttcttttccatggataacaaggtcccagtttttgccaccaaattaactagatgaatgcattaattcctcactgctctttgaaaatgctgacacatctgtatagatcccaaagtattaagcgaaaagtacctgatgcacagttattactaaaagaatgctagatgttttgccttctcttgcctctaccctgtgacttgtataagaacatccctgatagaagactatcttagcctccaaggaatatctgcattctccttgatgctaacggtgccttttttgatactgaagtataaaactgaggcaactgctcaatttaacaaataaatctatttctgctctcctacttactatataacatgcccatctatgtaatttgcaaactgatttacttttccggcagagacaacaaaaaagagcacagctgcatatggttctcactttttgcatttcatataatagaaacttgaccactcagaaaactcagtacataagtagattcaaaagaaaaaacaaattatgaatgaatagcttggtttcacaattgttgtgcgactgatattacaacatcatttaagaaacactataaggaaaattgttaagataaatcatcttcatttttaaaagtcggattagttgagcttaagtgataacagtaattcttttaatcaaatatgaaaatgtctagcctaattttaaacatacgatttttcttcctattatttttactttgcatcctaaacatagatgtattttaggctttcatcattgctttgcttgtcatttaacagaaagtttctttattaagtctttgtttctttttccatatttagtttcagatgcaggtggagggaacagatgaatttctaaattgaaacataaattaacttttgttaatgttcagtcaatgcatttcaaatctcattttctgattcagaaagagataaaaattctacatccaaaatgaaataagaaagagtaatgttttctcccagtctttgtcggaactcagaaaatcccaaataatcacttaaaaaactcttgtaccccatttcataccaaatgtatttagtacaactatctcactaaaaaacatgactatccacatgtgccttttgggcacagtatatataccaacaaccccttgccattaataccattagtgcttgcaggtaaggtagcaatacaccatactaaatataggcttctaatcaaagaagtcacacaggatgatcattaatacttatatccatggtgctcaggtgtcttagaaagtatttacaatctaaagtgtcagtatatttgtctcttacatgtgataaaactagaaaggctagaacaaattaacacaatctagaattttagagtttagtatctttctaaactaaaagattactctcaaagattagtatttttaaatgtatattagttttacattgtaaaattagggactcttctaagttaaatattagaaaaaaaatcagtacattgatgatcttatgtattagacctctggaaaaaatggaatcacttgagaacactgctatggggttgtgatttatctgatgttgtatattttgtatttagcatacagtgaattttaaaatgtatttgtggaatgaatagctaagatacattacaggtaggatacacagcaacaattacttttaccctagtaccttagaactagttaaataaatttctcagccaaaggtgtgatgatgaaacaaatatatattggaatagaccagagatataaaaaaaaaaatttaaataaacagaatggctcccagctcacaagtggctacaacccaattcataaaagccatctttgactttttgtgcatctgaaattcattctaagctatcacctgtgacagccttttgtactgtgttttccaatttttacatatgtacttaatatttggaagtaacacataatggctacttgccaatgacagttctgtataaactgtattacccaattttctgcacagcagtatgggtttatacaattagttggctattttaatacaatagtttttttcatttttttggtttgtttgaacagttgtgctccccaaagatctcaaggccacttatgttgggagttatagggagaatggaaggaatgtgatcagatggaaggataaatattccagaatggagctctacaataggctgagtttgagttaggtagtccctacatcccagtttacacctactgtcccagcgtagttattaataggaccctttctcactctcaaagtatcccagtttaggcaagaaattacatggccaccccaaggtagagctggttctacctaacttcctcatattcacatctatatctaggcaagcttcatgacagtgtcataaccatcagtcaggcatgtacatgtacggggagggaaggcgtgcaggggagcaggagagagggagggagggagggagagagggatggggagggagggggagagagagggagggggagagagagagagagagagagagagagagagagagagagagagacagacagacagggggcagtctctgctaaaaagtaagtacacttacaaactatcacatggataggtgggtgggaaaaagtaaagagaaatttctgcagtgcaatacctatctccaattatctaacactattgatgcagcaatgagatactgaatccagaatgagagaaggtagctgaccttaccatgattcacccttgttcaccttaactatggtgctgcacacaagagagaaaaaggaagaaagcagagaatgtgtttctcagcacacatttactgtgctctctaacaaaccaacaatttagccctttctgataattgctttttcctccttctaagacagcattggagatggaaggaatgtgcagtacataagctggctggatatgtattcaattgtgattggatatgtattcaattatgatcaaagtaaacgaactaattttacaaactgataattcattctatagacatgatttttaatcttgtatatcacctataatattttataatatttaaggctgtgattggaatattaaatgtaattatgtcataatttcttttttaatttttaatgctttggaagtaaaaccatagacctattgtttgagtattacacaattcaaccatgatacgtgtctccaaatgtaatataatctaaacagtaaaacataaattaacatgtcctttaaaaatctgtgtattaacatatctaaaaaaatgctgtgtcagttagtaggagagaaagcaagccacagacatgcagacaatggagggccagggaggacgatgaccatgaaaatctggtcctctcagaatgacggtagcatttagacgtcacagcttcattacatggccaccaagaccacacaactaatgcaagtgaggtttccagaaaacagatctctctcaagttttagaactaagaagcaagttgtaaagtgaccatatcaaggtattctcaaggtctggaagcctgtcttgggatcactttgccttctctacctggctcaattcaccccactgtgaagtcagtctttgattcatccatttcctggtgttagacttcagatactaaactctgtcagaaagccttaaaagtgaaaaaaaatatttcccctgaacacatgtatacaatcatttaaaataactttgaaaagcttggaaatagccttaatataatagtagattatatgaaaaagtgtgaagctattaaaattgttatgcatctagtgacgtggaaagataaacttttactgttaaagaaaaaacatgaaacagtacttttgttaaaatatatacatatgtatacacatgcactgcatacatacatgaatacacacacatataaaaacctagaatgttatacaccaatgctatcagcagttatctctgagctgtgataaatgacaattattttatttccttatgtttactatccatgttctttaatttttccatttatgaacattgaactactttccaggaagagggaaaaaagagagttgcagaatacttttcacaactgcacatgtgacttcctcttgtcatgtcagaggcagaaggagcagactgtaggactcaacactctggaggggattttgtgaaatccatagaaaatttttcagctggcttttggggtccatgaaggtaacttcagtgtagatttatgaccaggaaagaatactgaagggccaacacaagactagactgtcttactctaaactcaccaaaggatggtagtgagaaataatcaggttaaattacttctgattttgaggattatgatgacaatgaggggtggattatcactacttacagaatctcatgtaattcttaaaacaaatttagaggtatcttagatattgttatctccatattacagataaagaaattgaggcatagaagggttaagatactttccatgagtcactcttggtggtccataaattaggagaactgggatgtaaatgcagagattcctgactttgaagacagagctcttaactactacactctaatagatacgtaaattataaatttattatcatggagcataattccttatttaaaaactgtggacagtaaggaaaatagattaaacaccagatacctctgccaattttggcttaatgatgcattcatcccacagttgttattgccaaaattttttgataatgaaagacaagccacagctttctataatatatcgttagattctaacatgactcctatcaaatccaaaagagtgggaagttaagtataatctttactttaataattgggaacaaaaagacacatctcaagttctccctggtttctacacacccaacagtgctgccccaaaaccctcacacaccataaattctgcgggaaaagagagaaagctgatgcacattcattccttagaactgaatagccataatgcagcaaagggtagagctgtattggcagaaactactaagaatggtgagagaccaataactcatgaaaaacaagtctacactaacagttttaatgactattctaatggtttaatggatagcactttaataggatttctagtagaatctgaaagcttctgaaagcttgtcttcaataaatctgtcattaacaaagaactgcattgcttaactacataaccatagtttactgagtctgaacacagaaaaagtatagcagttgtcatcctgtattaccatcaccttttcaagtattctattaactactgtgagagagacagctacaagatcaaaatgtaggctgccagtgaaagaggcatatttatactaaggggatgcagtagacattaaataaaatacaacagaaagctcacaattatagcttgtgtccaaagaaaaagctgaaacagtaactgtaatccaaatacacagatatactaacaatgaaatttcaaaaactagctttagttctctttgaaagagtattaaatgttttggggtgatttgtttttgaatgcctattgcactctgtgtctacatttgacttattttgtattatgttgcttcctgtactgatttaatgttctttaaagtcaggaattgccatgttgtggtgctcagggtacataccaactcaatataaatattggattggctataatcagtcctagtgaataattttaaattccagcctttggctctgttttcctctgtccatgtctgaggttctcatttctgacttttttgcactggaatatttcttgcttggagagcactttcttatccttttcttttttttttgcttctaaattctaccttcctttcaacaaggttcagcttaaatcccactctcccaattcattactgcctggagctttctcttacatgcttccatgtgtgccactatcatgtgttacagactggagcatccatttggcaactagctacgtttagccttgtagcatttcttcttgtaaagttgtttgaattcattaccataacttatcttttcatttgacaattctttatttccccaactctatagtaagtttctcaatggaaatactgtctggtatatatctgtgtagtctagaaaatggctagcccagtgcatgtaaaatgtatgtaaaatacatttttttttttttgtaattttaatcatttcttgtctcaatttctgtgaaagtctttcaaggttgggaaacttatttctttcggaattacacgtagtcttatatataccaggatcacaaacctgaggataacagactgatgcattcttcgagtatgttctatcaatgctgatagctgtaaattcatagactttacagcaattatactgattatcaaaattactgaaaataacccattggctaagctatgaaccattcaagttgtacaacttgaacaaggcctagagtatactggaagaataaaaataccttctcagatccaatagtaggcaaatttgagtaaatatacccatgctaggagatttatatatgtctgtctggtgataatgtccttgtaaaaatggctccttcattcaaaatcaaaagcattatcacttgaggcaggagttcgagactggcctcagcaacatagtgagacatcgtttctaaaaaattttaaaaactcatcacaaaagatggtaatgcacacctgtagtcccagctacttgggagcctgaggcaggagaatagtttgagcccaggagttcaatgtcgcagtgagctgagatgagatcatctcactgcactccagtctgggagacaaagcatgacccactctccaaaaaattaaaaaaaaaaaaaaaagaaaagaaaaacaatattattaatcaagctattcaataaaagtaaacagaattttattctgaaaaagacaatatgtttgaggtcatttaaaacacctattgtttattaagaaaacttattaagtgatagattcagtctttacacagagtgagtcttatttactccatttcaagggtatgctttgaaaaccaaacaatatagcgaacaaaaaacaaaaagcctaaacaatttcataaataacaatatgggtaaagtaacaaacataaatggcacgctctacaagatagagcctcttttaccaatataaatattaaaatataagcaggtcatcttaaccaatgatttacaataagggaagaaaagaaaaatatctatatgattctttggcatctcatatttctttctcgggggggcatatatttcatccagctaggggaattttggatgaaattataaaacaaaatactatgcctgttaactgctcccacagcttagagaaaccctaagaagttctgccagggaagcataatagagaacaaatgctgttccctaatcttatttcacatacattcaagtaacagaatatgagaaagagaaacatgagttttccctacagcgggtccaaaaatctgagagtctgaaggattgatttttctgtttaaaaaattaggaaatactttgaaacacacattttagacagttgctaagacactaactgccctgacctactgaatttccacatctttgtatgtattgagtgtcagaaaaagaagaaatcccatcacccctcacatggtacatgtaacaaacgtagacaaaaatgccagtcccattaaccatggagtaaaactcatagctgcataccaaaatcctgacaaattctagttattgtggctttggttaagtttggataaaaacactaaaggaacccttggactcagaattcaagggcaaaatttatgcatcatttatttttgtactgcagagtctagcaaagtacctggcacattgtaagagcttagtaaatatctgttttatgagatgagctgaatataaagctggaaaattatatagacttttaaagaaggagcattcatgatcttgaaaattgtttcttaggtagctaaaatttttatttttatttatttttaaattttttgtagctaaaatttttagaattggtcttcttgttctcaaggccatttgggagaaatgagcagctttgtttcaaagttcatctgtttattctccagcgaaaattataatccttggtctgtggcatcacaattggttgctgtgggaatgattatagatcaaaaacaaaacgattatatcccttttcaagagcaaatgagtaccaagagcagatgaagacttaaggaaacaaagatgttcttttcatgcaaatatttttacaatacaactgtggagagataaatactgaagctggtagtctttatgaaatttataggcagatttttagctttggggaaagacagctccctttgccctcagagttagctttgagacatgaatactacagatcatttttctttttttttttttttaaaaaaagaaaatataaagacactgagagcgtaggaaaagtgagttctgtgatcagtattcccctgttgttttatttcaggcagaagaatgtcttcctcatctgtgtacaggatcactgtcagggagcttgatgtcctgcactgtcctggcaatatgttgcccaagggaggtccaccaaggaaagccaaaggtgaattctccacctagaaagaggaccatgcccataaagttgctgttcctccgtctccaaaagacttctgctgcagcacagtagtagttaagagttataacctaatgaagcatgcttattcatgacttgataaatgatatctctctatatatcatgtgactatgcttggaaagtgggagatgcaaagagcaaactagactcctccttctttctctcttttgcaggagatgcagagaaaaccaacctcctccctctttctctcattccttccttctctccctctctcttctttctggcttttctcttccttctttctttccttttctttttcttttctttcttcttctctcttctcttctcttctctctctctctctctttctttctttctctcaacttatgcatgtattaattccagaaaattttaccatgctagtcacaggaatatcctgataaacgagacaccatgaagaagctttcataatagcagaagacacaaaagtaaaactgaagaccctgtaatcccttgcaatgccatggattcaacacagcaaacagcgaatcaaatctgccatatacacagtgacaggcacctgtatcaccctaatcttggccttgtactcaagcctcaagctggagtttggcccaaattgacaatggcattttcaaacaactcctcagtgcccttagtttccctccatcaaatgtttaaaagcaatacaaacaaaagaaacacaaatattcaccaaaggtagaaaaaaaagcccagtggtcttcttgattctttataatatacccacttaatatttaaatataaagtacattcactgaactttttttttttaaatggtgaatttgcccgggcgtgatggctcacacctgtaatcccagcactttgggagaccaaggcaggtggatagcctgagcccagtagttcgagaccaacctgtgcaacatggcgaaacctcatctctacaaaaaatgaaaagttagccagtggggtggtgtgtgtttgtaatctcagttacttgggaggctgagatgggaggatcatctgagcctgtggaggcagaggctgccgtgaaccctgatggtgccactgcacttcagcctgggtgaaagagagagaccctgtctccaaaaaaaaaaaaaaaaaaaaaaaaaaaaggtaaattttatatgtgaactatattgcaataataaaatgatgaagaaaaacatataaaatatatcacacaagtttatttctccctaaaactgccttatttcttcccataagtaaaattcctactttatcacaatccttgtaatgtttataatttgggttctcacatagaaaaacaaacatccttaacgtttcaagttaacatgactttaggaggtaatatgatggttgtttatttttcagaaaacatttttatgtgtttgtttttatctagggagtctacttagaaaatgtcatctattgcataatgttagatgtaaacttgcagagacttcagccacgtcacttaactgccctgaaaatgtcttctctacagtaaaataacagcagtgaacgaggttagaagattctagaaatcctcaaatataacttcacagtagaaactttgtgacactgaatttaaacttaaacctctaaaattttatgaaggattttttaaagataataggatgatttcttgagctgtgacaacaaggatcaatacagaaggaatagaaaaagaacaaaaatggaaatcaatgcccagttgcacggcaacatccaccaactctaacacttagactgaaaatttttattctccttgtgtctcaacagatgacaaggaggtcaattaattactggtagtgggtggtaaaatcttctaccttcccttatgcagcaccctaactgctcttaataaaaagggaggcagcatttcattgttcattaactatactaattatagcttctcaatcactgcagccacataggcactcctgagttgtagaacggcaatagaagagactcgacctaagcctgcagggatgggagtaggggaaacacagcattgagaaaacaaaaagggaaacctgacatcagaatctgaacgttattacatttacattaaatcatgtttcataataaccagagaaacagaatttcagcaagagagaaagaatctaaaaagatcgtccagtccaatcacctaaattatgtttgagcttctgcctcgtcaatccggctcaataagttatatgccacctgacatactgttcattttaacagaactaaaagctggagcaaaagcaaacaaaacaataataacaataaattcttaagctaatggaaataaatgtaggtaggcagtggttttgtatcctcctgccatcttgaaatacggcaagcatcttctgattgtacagtaacagctcctatcttttcaaatcatttagcagcttttgtatgaaattaagttgcagaaacatgaaaggattttgcatatatgaaaaggtgtttttagaatcttaaaggtgaatattactatgtatcatattaaaagacttataaatcataatttattgtggtgagcaagtttccccttcttcattggtcttatctaaatgaaactggaatctgactcgtgatatgtagtgagaagggcaccttgccagtataggtctcacttttttttaatcttcagggttagacaagtaggtagactctggtctataactgacaatgtcaaaacaagaaacaagtcaataccaactatcccctgtgagagttaaggctgagtctttacacctttaaatcccatcaaccatctgctttttttttccttgattttatttacctagatcaagatcagaagtcaaaggcagtcactataatataggtagttatagaatcaatctgatgaattatttctagcccaactaatcaaatatatttttctgtttgacaagcttaggatggaatgctatttgtttcagatataaactataatcctttcatcatcttcaaacttgctaatttttaataaaaattaaacaagagcatgaagcgggtggctgggtataaaggttcctatccaaatcatttaaaactaagtcgttttgttgttgttgatagactgtctctgatgttgaaaagcaaaaataaaatataattataacaaaaagaaatttgggacaataatccttccttggggtcacctgactactatgtgatcaccttaacagataagttaatgacaacaaattttccatggtgaaaactgtggtgaaaggaaatcaactctcagaggcaactatttatagtggtcagaacattacccagacctcagactacacgggttcatatcctagctttgccatttactagctgtgtgaccttgagtaagttacttaactttcatgtggttcaacataccttctgtaacatggggagactaacagtacctacctggaaggactgaatgagttaatgtttacagtaatgcattccgaagaatgtctggcacatggtaagtgctatacacatgtttgctatcaccatcatccttgtaaagcactatctagactctgaaactctatggaaagactattatgatattaaaatgtgcagtttaatactaaaaaaatgatataaaaatactctgttaaactggcagaaaataaagaaggggactgggaagaaaagggaaggaaagaggaagagaaggggaataaaagaatgagtgaagggaggagggatcatgagagaaagaacaaattaaatcaggggtgtctgtgagccactggttgaagtttagaggactgatgagtgcctgctgttaaggaaatttttttagcaagtgatatataataaagttctgattatgcttcatgcatgaacttttaagctaaagccaaatactctgattgctgcatctgtgacgatggaaagactaatgtttcccaaggcctagccaaaactgcaaattcatgtaatctcttaatgcttacatccttcactttcatctacactcccaaagcatggtggtgtgcccaacatttgttttttcaaaaagaatgacaaactgtttagccacagtagaaaaaccatgacaaataatactgccactaccattttataattttacaattaaatacataaataagtaaagtcatccctatgatgctgggttacatcaggctctaggcagccttgttccaatctcttcttgcagcattgttaaaattttccccgaaagctgttcccagcagtgacataaacatagacgtactcatttggtccctcaggtacttggagtttcaggaggaattgtaggaagtgatttccatgacttttctgaacatttttgaaatcacttggttgcagactccttcctatattgttatgacctttcaagggtgtaatcacctttcacacctcacctctcagcagcatgaccctgagctgcaatgacagtcacagaatatgttgggaacccctgagcaagccacgcttcttctcatctccatgcttttgcatgcacagatccctcagcctgggggcttgcatttctggcaaacttcagtgactctccaagtcatgggtactctgggaagactctcgtcaatattgtcccactcccaagattaacttaacaattattttttgttttgtttttttgttttttttctgtttctcctagaagactatggactcattcaggacagcttatttcttgattatttttggttctccagtaaatgttaaacagatgaaggcattcaagctactcctcttataaacaaagaaactgagatcaggagagttaaataatgtgtctaggggcattaaaactagcagagacatcaggacagtttccattcgtcagtgaaaatacctttttttgatattttaatgtggatataatttccagaaatgatattatgtacaaaatatgaaaagaactctgtagttcttcataattaccctccatccttgtcaccctttaccttcccctaattgctttcatagagctcctttttggaagaatgagaagagaatgttatagaagataaaaatcacttgagaaaaaaaagtcatgttaagtgactgacagataggtcatgcatattgaagttcacaataacaagagccacttctgttgaccaagcgcagagggcaatgggccaggtgcctaacatatattcatcttcataacagtctcatgggtagatactaatcttctcatcttaaataagagaaccaaggttctgagaggtaaagcaactggctcaggatcaagcagcgtagctactaattggcccagtcaaaatatgaaccttgttttccctgacttcaaggccctccccagcatccactatggcatccctctaagtacacacttagcattccggtgctaaaatcccaattttactttgaaataaaaatgcaactcaataaagagtgtcttttttcagtccttgctatggtctcttggaagttgaaagcttgctttggaagcagagacagagttgtttcctgagagccttgggctccacatgggagcaggtgaaaagacattttggagaatgtccagtgatggtcaagggccaattagttatagagaacttgtatgagaacaacgactgagaaaaaatgaaagttgaaattgtatgagaataaggactgggaaacagaaaacgagttatgtgagagtcccttaagacgggtaggactcccacaagaaaaaaacaaaaggctctactatgaaagatacgaagtttaatgttagtaaagaaaatgtctgaggttttttttttttttttaatgtgggtgaaagaacaaacattttaaaagtctaagtagaactaagctttggaacttgagaaattacttgcactttgagttttcacaactatagaagatcagtaagaaaaaaagactataagcgcatagacatacgccctgttttggatgcaatgtttcttctaaggtgagctgctgtgtctttgtgttctactagatttgtttataagatgccaaaagcagcccactgggaggggactctgtactttttcattttacttggtgagactggtccttaactgcagaacaaagacagcatgttctcagatggccgactggtaggccaatctttgctataaaagcggctcagggactttattcagtaggtacttttgagttaaatctgagaggtctgcattaaaatgtaatcacttctgcactgtctagagatagtaatagcctattttctgagagaaaagagcctgaaaataaggcttcactgctgatagatcaggtggggatgtcgactggaaaaagcagctctttacagcaggacactctttcttctgtttgctcctgttgttgatactagcaattttgatcacaacaaagagtttctatgaactgtaaatttagttagaaattgatccagacacacactttggttaatcacctgctgtgtgccgagcggtgagcttgttaccacgtggccaacagcataccgagaggccagacacctgaccaaaacacctgacccagagaggcttgatcacagcaaatgactggagagtaagaaagggcaacataacaagtgataattgcactggtttaaactagcaagtttccatttctttcagtcttttattcttcttcttcttattgttatgattattattattatttttttttactgacatcagcaaagccctaagggtttggcctgggataggaaatggtagggtttcattgattctaagacatacatttcctttccacattctaacatctctgaaattgatgtgcatcttaaaattgatggcatcgtgcagttataggggtgatatcttttattccttagtggtacatgcaatgatggagtatcttaaaattgatggcacctagatgagataaaataagtaatagttactaagactactgagtactggtgtcaggaaacctgataagcatgtatgtgtttgtttttaatgattgtatgaagtaagtactatgactgcttctttatatagagatgaacaaactaaaatacagagaggttcagtcatttgcttaaggtcacacagtttgagctaggggccaaactggtgacctgagccaagggcctgtatacttagcaactgtgtcataatatttattcccactgctggctcaacaagtagaaagcccggagtggcaggcagagaggtttggacccaatctgagaagcagaaaaactgccatgttcgtaaggaattgggcaaagactctcccacacccacctccaatcccagtgtattaggagattctgatctggaatagtaaatttagccattcatcttcctcaatttcatccatcccaggtacaaaaatgttgttactgctttttatttcacaaaatcgctcatttttctcattccattaccaaaccaccataatttgttctcaacttttttaaaaacaatcttttatctcttgtgactcatatgtcaaaaatacttagaaatggaggccttcccttagaaatggaagagtctattccactcttccactttgcataaaagatgaaaacagatctctgtcgtccaccacttccttccttcaagaaagtgggggaaccaccttcaagaaaaaatccagtgcattcgaagttggccaaaaaaaattgtgtgtgtgtgtatgtgtgtgtgtttggtttcttgtttttgtttgtatgattcttgaatacatgtcccccctcatgagcttacacataaattataaactaatagaaagcagatatgacagtagttttgcattataagtgctcagaggtttacaaaacctaataatgatgactgttttactaatgatggttctgcgcctgtgaatacactgtggcacatgtggtcaaatataccaagagtcttttccaagggaaaatagaaatgttttcttttgtggtcattgcttagatgacagacaatttttgtcccctctgcggagaaatacaatgtttactatcaggagtgaacaaattatctatggagaaaagcaatgcgtccttagcatgtcatagagaaccactgggttttcccaggaatagtcatgcaatggaaattggtaactatgacattttcacagaaattttaaatatcaatattttgatctagtttgatactaaggtttctgaactctatcatcagggcatagtaagaaataaagtgtgaaacatttaagtgtttatatcaggtaagttaaggtgcagtgaagaagaacaaaacaagatgaatttgtgacctggttttaccacacatagtaggtgtgtgaccttgggtaagtcacttctttctcagtcttatgctccttacctctatgatgggagagtgaaaccacatgatctctgtggtttagacagctctaaatattaaaaaacatgacctaagcaatgtttttaatgtctctatacgtctcaacactgtcttgatgtatttcattattcatcaaggaaatatatttttcctttatctgtcttactgagtgatgggaagattttaacttactctacaaaggtgtaatacatattgttataaaaacagaaggacagggctctgatatctgaaatatttcatataaaagggtcattatcatcatcacagacaggagatgtgagagtgctgccatgagaacaggaagaaactcagcacatgtgggtgctgaatggtgggagacatgtgagcactgagactggagacagtccacatccagagacggcagcaaatgtgttgggactgggctttgtgatgagaacaaaacagatcaaagaggccttcttcagggaacacttctgtgaaccacagagtttcttgtccctctccaatggcaacagaaagattgctccgagttaatacatagctttaaggtaatactactaacagagctagtgctgactaacttgaaactagatgtctgatgactgttcatctctgtgtaactaccatgacaggatggactgtggtccaaaatgtgacttgtaagtgagctgacaggaactcagaaaaaatgctgttgttgtaactacttaaaaaggggttattatctcaacccacaccacaaaatgtataacatctagaatgtacctgaagtagagtatgtgatttgggacagtatttctattagaaaactgtaccttgaggaccacattgggaactagttttacattttctctaactttatagcttttcttgatagtgaccactgggatgcccattaattttttttattttttttttactttttttcagacagggtctccctctgtcacccaggctgcagtgcagtgacatgatctcagctcactgcagactcaaccccttgggggtcaggtgatcctcccacctcagcctcctgagtagctgggactacaggtgcatgccaccacgacaggctaattttttttttttttgtagttttgcagagacagtttcaccatgttgcctaggctggtctcaaactcctggactcaagcgatctgcccgcagcgtcctcccaaagtgctgggattacaggtgtgagccactgtgcccagctgggatgacaatttattacacaaagacatcatcaatatcttttaaaatgtagattctgaatcagtagcagtggggtagtacctataattctacatttctaacaagttcccaggtgacgccaatgctgctggtctgtagtccacactgactatgagactaccagaacgttcatttctcatgtgcctttcccttgataaaatgcacttcactcctcttcctagttccactaagagtgccatcttctcttcaatacctttctcaattctccagatcattatgacctttactgaatcccaataacattccagcacttaagattacctccttggtgtaattctcgtttgattgtatatacttgtctttgacaactacaaactccagaagtacaggtttcttacaacttctatattttctcagcactgagcacaatgcttttctgtagtactgtagtggataattattagttcctcctcccagctcacaagcctccttacacagaaacttcgctctcccccatctaagatctgtatgagtggactgttagcagttacgtcccaatgtgtgtcaccacaacaaacagtcaattagatagagttcagagtttgctctctggcatttaaaacatgactggcaagtacaacttagtctctttatggggcctgtacgtaaatgaaaatatgattacagaccatgttttctgtgcgtgggtgagaaaaaaagaagacgctggcttgtataaggggaagaataaagccaccacagagaaagcacaaagatgaaagctccagagaagatatcaggaaattgccacagcccttcagttttagatgatagttcttaatgtgtacctttactgttagccttggccctataatacatcaaaaatgctcttctgtatttccttgagaatttctaggggctgcagttgcttacgatctatctagtctaaataagatttgtatatatatgactgtgatgatgcctactgattaaattttaaatatactagtctatatgctatctcagaaaatggtgaaatgaagactgggggtcatgttctgtaatacattaccctaaaccaatgacattcctcaaattgaagtctttggagcacctgcatcaaagtcacctgaagagctcttttaaaatgcagatttgtggataccacagctgacctattaaactagcatttctggggctgggaccaggaatttcaattttattgtgtctctgccaggttttggtatcaggatgatgctggcctcataaaatgagttagggaggagtccctctttttctattgtttgtaatagtttcagaaggaatggtatcagcttctctttgcacctctggtagaatttggctgtgaatctgtctggtcctgggctttttttggttggtacgctattaattactgcctcaatttcaaaacgtgttattggtctattcagggatttgacttcttccttggaatttcaattttaaataggcaaccaaatgatctgtaggcgccagcctaagattttgtttggcaaggtctacacaaattactctgatttaaagattcaccagcctaatatatggactttaacagccataccaactttaaggaggactttcttccctgcattccagatgccattctcaaattgagactacttaaattccagcaggacttttcagtttcatctcagaaaatggacatctaaagtgtttataaagacctgcagagatggggttacactaatttatcaagtccattcttccagctttcactaaattcactgttggagttcaacggcctttacagtacaggaagtgtctcataggatctaataatactgtgctacaatttaacctacttcctcgtattctgacctcaggatcagtgcaaacagctttcacgcctttaacctgttttagtcttagaatcagagtaaaaaaaaattagcttcgtgcatcttacaagttctgagtaaacatttactcacagtgattatgccaaaataatcaggtgtttgaaagcaatgtgagttttctttcctccattttctttgctgaaagccagtaaaaatctattcaaatttatgtagaagataataaacaatttttccccacaaaatgttgctctgagcctaaatttttatgttgaggtcttaatcctattatcacagttgaatacaacacttaaacatctccttcatgccggttaaggcacagtagagtcaattcatgcccagggagctttaatcatggatcatcatcatgaacatcagtgaagagtctatgtgggctatcaggtccacagctaagcctactggggaagctgtgcatagcagcattgccagcatgcagttcataactattttcaagaagcacttctgatctaatggctaaatgaggatcattaaagtatctttacatgtagcatttcttgaaaattccacatttaaaagaggccagttattgcattcaatagatgcaactgagattgcttgagtgatggttttatagccatgtgctgcataatgacatttcagtccacaacaaaccacaaataagagactgatccataaaactataacagatctgaagaaattcccatcacctagggatgtggtagctgtcgtaacgtcctagcacagtgcattactcctgtggttgcagagatgttggtgtaattaaacttattctgctaccagtcacataaaagtcaggcacatacaattaggtacagtacataatatttaataagtgaatatgttactagtttatgtgtttactacagtatacattttattgttattttaaaatgcactccttttattaaaataaaaagaactttaaaacagccttaggtaggtccttcaagagttatccagaagaaggcattatcatcataggagatgacagctccaggctgtcaccctgaagacattccagtggacaaaacgtgaaggcagaagacagtgatattgatgattctgactctgtgtaggcctagattaatgcatgtctttgcaacttagtttttaatcaaaaattctaaaaagttaatataatttaaatagaaaaacgcttataaaataaggatataaagaaaaaatgtttttgtatagctgtacagtgtgcttgtgttttaagctaagtgatatcaaaagagagtcaaaaagtttaaaaattttataaagtagttacagtaagctaaggttaatctactattgaaataaacttttaaaataaatttggtatagcttaagtttatagtgtttataaagtctacagtagtatacagtaacgtcctaggcctccacattcactcactactctcactgacacccagagcaactaaaagtcttgcaagctccattcatgctaagtgtcctacataggggcaccatttgtttgtttgcttgtttgtttgtttgtttgtttcactcttgtcacccaggctggagtgcaatggtgcgacccttggctcactgcaacctctgcctcccaggttcaagcgattttcctgcctcagcctcccaagtggctgggattacaggcacacgccaccacgcctggctaattttgtatttttagtagagacggggtttcaccatgttgaccaggctgatcccgaactcctgaactcaggtgatccacctgctttggcctccaaaatgctgggattacacaagtgagccactgcgcccagcctaaaaatcttttttacagtattttttaccttaccttttctttgtttaaacacacaaatagttgggtatagtaacttgctgtaaaggattgtagcctagaagcaatgggctataccatatagcttaagtgtataatagactatactatctaggtttgctatactccacgatgtttacacagtgacaaaatcacccaagaacacatttctccaaaggtatccctgtcatcaagtggtgcatgactatattattgcccatggtttaaagttatattggtggagagtgaattaacggcttactaacaggtcgagctatcatatttccgtaatttgtaacccattacataacttataatcaaaaataaataattaaagcagggctatgaaaaaatatcacatggcaaaataataagaatcatataacaataaaaagtaggttggagtgatgaaagatttctggttcataaaaattgacataactaagagttttttatggtgccccaggtgctatttatgatttgccttattttctctaaactcactatggagccctaagccctaaattagaaactatagaaagtgttttaaaggatactgcataattttaaaggagctattctgatcaagaggaagagcaggaaagaaataagctgcgaccatttgagaaaagaagacaacgtgcaatccggtgtgaattttcctagcattgaaaatgttctcctgaatgcttggagcagaataaaggaagatataacttcaccaagaggcaaggaaacaaacaaaatctttgcatcctatcaaatatgtgacaaagatgctgcagtatgcaaactgaatgaaacgtggtctggctcttgagggtggaggtgaatgagactacagatatgttttggttttccagcacagtaacttaaaataatgaacatttgaatatttgaagattttgggaaggccatgccacaggcctcactgctctatgttctcttacatggagcttcttcttatttttgtgacccctctaagccacttgaggttgggggtcctcttagaggttactacagaatgtgacagggtagaatgttagcgctggtaggtccagtgcaactgccccaattaaggctgatacaacagataccaagaggtaacaggatgtgttaacgactcccagtaagtaaatcaatagaaaccccgatggtgaaatttgggctgcccaggtacccaataaccttttattatttggtatatctacaagattttagttgtacattttaatcttatgttaaaactggtctagaaaaaacaattatcgtccagttatcaacaatgcattaattggcttcattaagggtccttgttgctggagaataccagaaatacccagttttataactttttgattgatatataccacaatatccaaatacacacacacacacacacacacacacacacgcacgcacgtgcatacacacaggcttttaatttacctccatcaagaattcacaaagaatctttaaggattctggaattttaagatagcattcagcgcaccattccttcaaaaacaagcaactctctgaaaatacatttctatcttaatattagctctagcattaatttagattgaaggataagataatatacacatactcaataattacagagttttcatggcttataaaaccaagagtcttgagaaatgtacttaatcttcgtaatctttctttctagatgaggattcttatcacaaatcagtgtatttggcacctatttggtatgctggaaagcttatcaatttagtatattctaggaactgaaaaatcagaagacaaatactgcatgatctcatttatatgtgaaatccaaagaagtcaaactcatagcagtagataatagagtggtgattaccaatggagggctggcaaaaggggagatgttgatcagttttagctagatggcaggaataagctttagcgatctattgcacagaatggtgactataattaataataatgcataatatgtaaatatatacaattattgccaattaaaaataaaataaaaataaaaaacagaaaattcataatctcagcaagtaatattgaacaaacataaaattaactttttcaaactgtaattactatattgcttgtgcagacacttttaagttgacggttcattatacatttttatatcatatttgagtcatatttaaagggaaaagcactgatgaagttaattttcaagaatatggtcaaaaaaagagaagagtaactcttgaaattactgtaaagaataaacacagtgaattacctcatattcctgggaaaacttcaagttgtcatttgctttcaatctttcaatgtggtctgcaagttccaagatgggtattggaggatggctagccatacctattgaaaaaagcaaagaagaaacacatttgaaaacaaatgaaaatgatgctaactattccaaaatatagagaatactatagttagaaatggcctgaaaatatgtgagtagtaaagatgttttaggtgaggaagcaggcaaatagtttggttactcaaagcaggacatgctctgggaagatgaattttgtagccaaatgaaaagtcaccaagcataatctccaaactaacactcctagtgtaaaagaaagcgttattgtgctatgaatcaataaggttagctagtggaaaaaactgacagtcaggcttgatgtcaacttctgctttgagtaatgacttttatgccatttcaaactccttctcctgcactgtgtgaaatggaaattgtgtggaattaaatggtgtaaagtgaaataagaaaacagacactgagaaaggcctaaaagggaaagagtagtagcttgatagtaaacataaaatgacttatgcataatcaaggaaaactaacttgaagaatgaaggttaccagggtaaccggaatcatctgaacctgcaaaggaaatgatggtgtaaataaaataaaatagaacaaattcttcaaaaaaaaatgaaatggaaagcctgatatattttttaaaaggactaattaaaatgctgcaagtttttacagaattcactatacattgtggctagtacaatgtgactactacattaagatcgctaatatttcacaaacctgtaggtgactgacattcacatgcaaacacagacacaaagaatgacatgcaccacgactcactgacgataatcactgacggcacaatcagacaccaaactgagcttcaaaaatgtttccactagtagcagattgtagaggttggggttgcagccttctcctggacatttataaatggccacactaacaactctgtgatattttgccccaggtccccattattcaacccccagcaaacctacaatctacttcaggtgtaaacatctttgtccactaatgagaaatggattcagggaagtgagcaaatggtgaaaagacaggagggaaagagggtgaagaaagaaggaaagcagagatggggtgacacattctagttcattcagccagcggaagatatagtaatttcatagattccatgaaaaataatccactattaattttggtgactcctgtgtctttctgatgttttctcacttttcatatgatttgtcttttatttctttcctattaattttacagaagtatcatgaaagagcattgctgactcttatcttacagatataaattccagctggctacaaaaacctgaactagcatgtccccagggaagccactgaagcaggaaaagaatgagggaggagctcaaactggaagccatgtgttgacattctgctgtcactgtggctctttggaggaaggctacagaatgatggccattgagtcaacatgacatgtgactactttaagagcattttaggaattataccattgttaaaagtcacccagtaagttcctttatctcaaatgccaaattattaatggttctggtaagttaagtaaaaagctaccctgctttttgaagacaaccactttagcaagtgttgtgaattgtggtggtttagtttttatggctatgaaggtctgcttccagtcagctaaaattttagtggagagccaataaaactgaattgcttgcaagtagaaactctttgttggtgatataataatgcctttggaacaaaattttggaaccctttctgaaacttttctgtattaatgatagaactgaaataatttacattctatggaggaagtgtgagggtgacagtgatctgataattacgtgatcttatccagatgaggcacccccaacgaaaagaatggaaatgcaaaggcataggtgactttaggcttatctggaaatggaaatggactgatgtggacatcattacagtgctttcacagagaaaataatagagacaaagatgtttagaccttttcgagcggatcgtgggagagagttattatcatatatggactgagtggtggtttggctagagagggaggacacagagccaatcagggaggcgtaggggactgaattactgctcaaagctgcaaaaagtaaagccagttggagacgggaaaagtattagtataacagcagtagaagaccataataataaccaaagatgtgatcaacatatttacttgtggcatgcactggcacatggtctggaagtattatattggaagtttattaaagaaaaattcaagcagacctacattgagtcattatattccacatcagaatatatatacatatatgtatcacatgcaagatatcacagcattaaagaatcgctacataaaacttatcattggataccatattgcactccatttctaagacaagtaaaaatggcagatggatgtttcacagaaaagggaggagaatctgtgtgaatccaatggtacaggagaaagaaccctggcttagaatactggacatgggttctacttctggttttggcatctactaatagggacaaatcaccttttgtgaagcgccttgatttctttaactgttaaaataagagtatagaactagataaattcaagagccattctcttcttcataactttcattcttcccacatatagacagaacttctgaacagagaagggtctattggtgcatatgtaagggttctaaaagttatcgtaccttttctttgaagggagagagtacttactttttacaaaatggaaaactagtatgcagttgaattgtttattttttgaactatttaagtttgttgctattttctttcattagccaaaatgtatacacagtctattatgatgttatatcatatatcagaaaagaccgaatgtcggcataaaaataatcatcaagagtaaaactcctctaagttgaaactgtttagctcatatcagaaaacaatgaccaaggatctacttcaaaatattgttacacaattctgcagaaacatctccgctgcccaatattgaaaaaaaatgttatatgatataaacaaatatgttagattttgaatgaaaaggtagacactaagaaaactatgaatttgacctcactgtggtaccttttcaatgttttgtctggcaacctgaccactgctcagtctataaaccaaagtctttactacatcagattttacacatttaaattacttgatgtgctttaatttttttttttttttttttttttttttttttgcaggctgtacaccagaccaattaattcaggtctgtggatgtgggagctatatattgatatttttaaagttcctcagcactggctcttagtcctataggattcatgatggggggcctataactccatttattcctttttttcccatttagaaatcatatcaggatttatgagaatgagatgagctttctcttggtgatattcttgaatcctctctaacaccccattagcaagctttagtactcagctattattggcagcaaagaacttgaagcacagctaacaaacagggagggcttgccagtgtcatgacctcatcagttagaagctacaaatgtacaatagaaatgtattattttttttttttttgagatgtagtctcactctgttgcccaggctggagtgcagtggtgcaatctcggctcactgtaagctctacctcccgggttcaagtggttcccctgcctcagcctcctgagcagcgggattacagggacgcgccaccacacccggctaatttttatatttttagtagagatggggtttcaccatgttggtcaggctggtctcaaactcctgacctcatgatccgcctgcctcgggctcccaaagtgctgggattacaggcgtgggccgctgcgcccgacccataaatgcattttaaaggcacgcatcaaatctgttaagactttttattttgaagctatgatctccacaatatagagtcaacatgaaaaatgacagatgcggtcactgaaatctgccttaggttggaggaaaaaacaagatggctccctttaatagggtacatattggtgagactgatgtcacggtgacttccttataagaagtaaactttaaaatcatggcattttaacctgagaggcaccttagagatgacttagtccagcactttcactttatacaagaggactcaaatccagaaaagttagatgacttctctacataagcccagacagtaaataacaacatctcaacatgcagcttgggcatctttctactgtactattccgagaacggcatttgcgatcttctaaatgaagtggggggcaaagtctccacagatggaatgggctaggctggtaagataaatgactgaagagggctaagtatcatatagtcaacattttcacacacagaaaatacgctcattcccatttcctcacaatgagcaggtttccagggctggcttttgtgtctctactttgaacagagactccagaaagaacagtaattctttactatgtgaaaaacagccataagcgtgacataaatggcaactaacgctcagtctcaatgtcactcatctttagggctagtgtacacattggggggcttctgaaaagggtgaaattattcagctccaggacttgctctgccaagtgggaatgcaaggccaatcggttcagactgttcaggttttcaacagccactcaaaatccagagtatcgtgtggcatttcctcagttttcaatgttgactcaaaattttgttgaaactcagtccatgtcaaacgataagctcttttgcagaccacatacggctaactagattatggcctttgttttaaaagaacaaaaccttctttaatctgtgtgtatgtgaattagaatcaaggagtgttgggagtgacagactgcatgcttgtatccacaaggcaatggactagatactgctttgtgctggggatataaagaagtatgcttcttgcatggttcatcccctatgggttcatctacctccccttctctctaacctgatcccccattatctctaccaattagaaaaatgaagcccagaggagttaaagaactcgatcaaagtcatcattatcagcagaactgtagctacatgaggaatctgatcccataccccgtacactctcatttagcacatttcacatgacgccatgctgtctttccaaccatttaacacccctggacaagtggtgacatgtacataaagctgggtctttaagactgtttgggctctctatgcagcaagacagagatcataaaccatcctcagtttgtgaaaaagtgtcaatacagggccttaacctaggtcatctgtttcagtggtggggaagaggaaaaggggatgcaaaaacacgtctgtattttccagttatttcttgccaaaatatcctaagtttccaagaaaacatgaactaaaggtattaatttaaaatgttaaaaactggaatgctatttggcagaatatttcttagaagctaatttatggtatttttgcttttcaaaagtcctgctctgttttactaagtcagtaaggctactgaatgcttcaaatgattttattatccatagaaaaatatttatcaaacacttgctctattttcatatttttaaaccttgcattaaatgccaataggcactatataactattctgctaagtagagtttttgaagtcattaataacggtggtacatcttttacatgatttttttctgtcactatatacgtgtgtttgtaatgactcagtaacagtctcttcatgattttccttactgataaattgtgataaaggctggagaacagtttgtgcttatggaccaaagagaagctaattttttcatcaaatcaattaccacagtcttaacaaaagtagacttctatgagttaacagccagaaagagaaaattcattcattaaatatttgtcatatttttgacataatgtatgcactatttagaattccctgaatcaaatacaaatactctgctatatttgttatttgtatcacaaactaatgataaattaaagataaagagaatattgatttgtaagcttcctgatacaaccataatgacaattagatttaatttgtgactggggatcatcattaaatgaaagagtcaccaacagtgcttttctgggtaagcaatgaatggcataattaaaattcaaaatttttacttcattccaggagtttctgtccagcctgggcaacagaggaagaccccgtttctgcaacaaaaatttttttaaatgaaccgggcattgtggcacatgcctgtggtcccagctacttgggaggttgaggtgggtggattacttaagcgtggaatgttgaggctacagtaagctatgattgtgccactgcactcgagcctggacaacagagcaagatcctgcctcaaaacattttaaaaaatttttgtaaaattcaattctaatggagagtttctcaaaatacagaatttgaacaagctgtttctttatatcagaaatttcagaaaataaaacagaaaggacacatccggtattcttaacctaggtcatatgcctaaattccttactgtataaaataaaatatgaatgtatgaagaaagtatatataaaaatggatcttgttagcattgatccaattaatagtattaatagatcagaagagacagctcaagagctttttaaagcttattcagttgctgtgcagacatttctgctgctgataccactatttctgatccgttaactttttatgagtttgtttctgttttcacagcccatcaatcacctaccatccatgtatgctttagggcaaaacatattaaggtcatccactgaatgaaaatgaggtctttgtgttgtaacatctgatcatcgagttttaaatctcttttcctaaaaggtgcaagcataaacactatagttttggttttgtttgcaggtatttttgggccagggaggaggtatgaacagggacagcagacactttaatattgaatatgcaggcagaggggaaggtaatgattggtgcaccaccaatgctaccagtagcatcttctcttacaactttctttgtactgaaaagaaagtgaatttctctaagatcctcaacctctaaattttctttgctgggaaaaagaagaaaaatgaacacatattagtaatttgtttggttttcttatatatcaccatcttttaataatattatgtttattttcatcattttgcccaattctaaaggccatgggccagagggtgtcaaaccttcagtaaaggatttttacagtattttgaaaagtctgtaattgggtctctctatcaaaatggtaaatgtgcctaccctaggaccctgctatcatatttccaggtgtctgacatgcagaaatagcaatgatggtgtcaaaatatatgggctcagtaatgctcattacagtagtatctgtaatagcaaaacatgagtaataacctagcctccattaatagggaatgagttaatacattttgatatctatagaactgactaccatcattgtcattatctgttaaaaagaagacataatacactcacttgaaaaaagtccatttttatatagttaaatgtcacaacagcaaattgtgtgtgtatacatacatgacatacacacagacatccctacctactctatattatatcatttaaataactacatacacaaattaattctggaaaggtatatatgaaactctatatggcagatatttctggagacttaattggagtaatgacacaaaatattttaattttaattttaaatatgtcaaataaaaaagaaaaaaaagtggtggaatgaagagtaatttttcttctctaaaagtgcttttgttggaccgtttcccaccatataattataaaaattttcaaacgtacacaaaattaaagagtaacataatgaacacctaaatggtcacaatctatatgcaatgattgttaacaagcttattttctattttccaaaatttccccaataaacatgttgcttttgaaattaaaaagatgttctgggacggagagactaaagtaatttggaaattgtttataaaagaaagaaagagaaaactttccttgcaaatggggctaacacagttcatctttgtttaacaagcaacatatctattcacccatcctagtgcgcacccagttactgctgtctacagagatgtatggagcttaatggacatttcctttaaatgcatcttttataagtgaatattttcttcccttcttccatagatcttaaagacttgtaaaacttgatcagcagttaataattccagtaaactcctctactacgtcacctctctcttttacttattttgcccatcttattccactatctgttagaattaataagtcaaatcttagctaaatgataccttcctatatacttaagtccccattttaacttggtagttattggtgatacaactgatgttacttaaattgcctttttcacactaattctggctgaccttgtacactaataatgatttattgtttaaatcattattctcttaaatgattaggtagctcatgttgtctcaaatataacttggctatacactgccatctgaaccacaataagacagacacttacaatcaatcatgcaaaatacttacaagctgaggtgcctgctttcaattgtgaaagcatgggcttccccgacctgttcaggtgtttacatacagtgtttcacagactgacaggatattttttttcattttaaagtatactttaataatgaaagtgtacaagcacaaaaaatgataaatgttcccgtatatttgtccagacttaccatgtgaacacatcacttaagtaatagattggtcctaacactatgcagcatcctgggatcctatcagactgtttatcctgaatctagtcctattcctagaaaaactaccatttagggggagaaaaaaaatttattcaacaattccatattgtctctgatgcagcaatcggttaagtcacaattacattatgctcaataagagaaaaataaaatagtttttcagaaggggctgggttggtgattcttttttcactcatcttaatgctaaaaaagaccaagaactttgttgccactaacgaactagtgggcttcagccctgaagtacctctagctgccagcaccatcagtgacttcagaatgagaagatacagcaactccttaaggtgctctgtacagattcaagtccaagctacttctttggaaggctctcagcagtgtcagagagtgacttgattcttgtctaaaagtttgaaaatgtgctaaagcaatgttcctctccacactctccaacctcacaaggatggttatactgacaaaaaagcaggtttctctgtcttttctttgtgccttagctgagcaacggtggatggaaatctaactttttctgatccaactatgtttgtggtactgcatttaagggtacagttctttgacgtacttagattgttggaatgctatatttatatgaaatggggaatatcgggcagaattaaggaaaaaagatctgacttcttaaatctcgattctccaaaagaataaataacttagaatgtaaatcaatctttcattcacaagatgacttttttgagaaagtagaatttatagaatcactgaactaagcaatgtgctttctttaccttctgaaaggcctactgaatttcaaatcgtaatgtttgtttgctattttatcattcataacagacccatcagaagcagaaatcaatttgcctttgggaacaaattctgtactaggtactggttatataaatcacaggcatcttatttcattgaaagacattttttgaacagaaggtgtggattactaattctctacttatgtatattattaataaatattctcaagcgttataatgtttggggataagcaattatacattcatagtagatatattaaaaagccacatttcagagagtgaaatgtaaataatttaaaaacctaaaaattagcgtcatagcacctgtcatgcaacacctaatgaaggattattttatttcattatccaagaaaacccttgattcttcgtgaaaaagaggagaagaacaaccacaaaagggttactgggttaacaaccccacattctgctctcatcctattggcaagtaattatggtaattaacagccgctggctaaaatctatgcaggctgaagcaaatggtcacatctctatgaatttcatattaacagcggagtctatttcctttgtaaaatggtaaaaatgttccagacagcaggccacaacatagagcttggatggcaaataaacaatttcagcaaatcaagcttaagtgaattgcttacctgagctaaagggcataatgtactgcttcctgagtgaacagatgtgctaggaccttaggacaatttctccttttctagtctcctcctctactacagctcctctcttatctcattttgtctactacagctcctctcttatctcattttgtctactttattcccttattcatttgaggtgataagtctaactttagttaaatgacaccttcctttatactcaggtccccattttaattttgtaaagtcattggtgatacaagagatgttacaattgtaacattcattcttctttctggtatcttacctaaaatttaacagattctctctataaatggatataatattcccaaatacattgggaaaattaaattgctaatagaattcttgagtttggccatatttgcaaaattacatctgaaagtgagaagtacttgcagacagaagtctcctggttgaagacattcctattctcttacctgcagtcaccagcacctcttaatcattctctctacacagttcccattcttgctttgtgtttattcccggaaacattttctgttggtgcgagaggaggtgaggtgtagcagcactctcactggctcccttcttttgggggtacccttgcctttctgctcaaccttatactgtgtttctgcctccggtggaagaccaaggttggttccagcacaaatgacatttatgtgaaaaacagaggaaggaggggcagtggagagctagcagcaaggtactgagaaatctgatccgtttttctatttccacaacatgttgctcttttacagggtgatgaggtaagaaatgcaaggaatcatgtagcagatcatttcttcagcttttgggtcctctatacattgagtttgctaaattgaaaggaatataaattcctgggtccattattaagaagttgcctgtaggccaggagtggtggctaatgcctgtaatcccagccctttgggaggctgaggcaggtgagttgctggagcccaggagttggagcccagcttgtgcaacacggccaaactccacctccacaaaaataaaaaaaaaaattgtctggatgtggtggcgtgccccagtagtcccagctacttgggaagctgaggtagggggatcacctgatcccgggaggttgaggctgcagtgagccgtcattgtgctactgcactccagcctggacaatcgagtgagactctgtctcaaaaaacccatcaatcaaacaaacaaccaaaaacaaaaagaagttgcctataggctgaagtagttagtatccacctatttcaaaaagcgctgacccaatgaaatttactacagtaacttaattcatatcaagttgccttaataaagtactgagtaggtgactcaacaagatgcatccagagggctacgacctatcctggaagatgacacaagtttgttcaatcatcatgtacacgttcccggtgcatgatgaaataattttttttaaagtctaacctcatatgagttagaattttttttaaataccgacattatgatgcttgtatagccacactgaaaatgctaaacatttctttcaattgaagagttactagttactatgttacatctacatgtaaaagagaaaatatgctgaacataataaaccatgttcaaaataattcactgtaaaatgtgtactgtaatatatctgcagtgtatcatactgtgaatcagaacatccatatggcacaaagaaacttgtctacaatttgtgggacaacactgcaaccacattttaatcccaaagacttcttagattagcttttcactttgttcattatcataacatattaagatagggtcactcggttttatattttcagctccctctgccattcataatttgccattcatttggtataaacatgctttagttgaaaaagtcaaatagatctaggcatgaataaacaatattgtgcagaaggcccctcagtaggaatagtagtgttcctctgttgaagcacttaatgttctttattttaagaaacaagtatattttttgttatcctcagtcactttatgtttctctctagtaagaagcctgaagtgatcagtgaaatttagtataggtaatatttaaaaatatttacctcattttcctccctccctccctccctttcttccttcctctttcagagtaccataaacacaaacaaaaaggaaaatatagaacaaatctatgctttcccatgggatgaaagatgtgtacagtcatccatttactcattcattcacttgatgagaaactgaattctttccagagtggtgtcattggaaataataaaaacaataatcaaagcccataaaaatggtagatattattataaagactatagttcttccaaaatttgaaggatacccatatttctttttcttccctacccaatttccggtttgcagaaagaacttaatttcctttcagacttttgcttgggcaagtctccataatagtaaaataaaagagcaggatgaacaaaatggctcaaaataaagtgataccttcaactcttaatatcaattgagctgtacaacttctgggaaagactgtgtgtggattagatgtgtgatgcttcttacccggtgtttgaaagttaaggcgcctcagttctacagggtctgttgggtggtgtgaagggatctccttattgttcggtatgctgctttttctagagtcggactctgccctcttcctatagggggaaaatagaaatttaagaagaaaagaaaaatcaattgaaacagatagaaaagcagagaattgcacctgcactccccccacctcccaagttttcagttttacaacttttcaacccagctgacttgtgacccagttcgggttgcttttcccccctggcctaattgttctctcaggtctaaaatttttgtttaagtcaatgatctcgaagtcctcctccaactgcaggattaaataattcagcaactctgccttttggtttcaaagggatcttggtgagatacgcatggacccttattgagcaattctctcttatctactagttctatttgtgaggaacaggataggatacccctaagttgccaatactaagactgttgttaccatagagaaactacctgaccttaagctgaacagctaaatctgtcccccttagccctaagtatatataagtggtgactacagagagtagatgccgtagattttcccataaggcaggtaaacacaagtgcatttttaagatgccaagttatcctaatgcctaggataatcgggaccaggtaaaacagaactcccctttctctttcaaatgtgaaggaaaaaaaacagtgttagctcttaacagtgttaagctaactgtgattaatattttgttaatgaaaggttcacagaaagatcagagaaaaagtaatttcacctggtgggtagatcagcgctcctgataatcattcaaggtgccattgacagtgccttgttataaatgtgattcttcacacaatacattttaactttgttctaaaagctatctactagctttattagatatccccatttaagctctcattatgtaattttaacaaatttctaagcaagaaatgtcagatctgtatataagatttctttatccaataaaaaattaatcacagagtcctaactatcttcttccagtttgaattagattaaaaacccattgaatcaatagaagccattttcaaacagtgctttttttccaaatactaacgcctgcaatctctacaccacagtcacaatcctagtatctcacccctgctcaaagcaaaggcgtttttactgtgggggggaaaaggtgctgcacagtgtttaggaactttccttttctctgttcgatgtgactgtggtacagctcattagtgttgctgtggcaatggggtctcattcaatgccacccaggtcgttctatggttagccagagggctcctgttaaatagcctttcttcccatttctgctcatctgtataaaataaaactaaccagggggtgaagagaagattgatacaaaggggacgtgcacatgatttgctcaagtgcagtgcctttggcaaaacatccttaatggaatacattttcatggctaagtcctattagacatgttgctttctcggtaccttagattaacctgtctgaggatttcttctttctacctaaaggtgtcagatacagccttgggacaaaatgtgctgccaacccattccaccaatcagaggtgagcagtattctgcgacctgccaaggtactggcagctccagttctatggagtagaaaggaagaagaaaagaaaaagaaaagacaaagggctggtgaaaaagatatgaggacgaagaaaaagacaggctcataagaccatgcgaaaggaggacatgatggccagtttcagagtaggcaatgtcactgtgtctgtgctatgggtcttcgcctcaccacactaagagattccttttaccactgaagatgcaaaatcgaaatgggttaatgaaacgtcactgggtgcagccagccagtcaattccacgtgaaacatatggttggtcttctcacttcaaataataccaatggcccttctcatgttttgatcattttgcataagttggcaaggatgcatttctttactaatgtgtcaggcccaacgactaaaatttggatttttctcccttcccattgtggctctgccattcttgcaagattatggaaaccagaattagaaatatctatctgggcaagaaaactactttactcttacaggtattgtagggtaacctccttatcttctttttccctgtggctggggtgagtgacactgagctggagggtagaaaagaaaactctctaaagtaatttagcccatttctctggtgcaaggaaagttaggaattacatcttgttgcaaagatgtgagtctcagaaaactcaagacatgggactaaaattacaattcacaatttgaatgaacagggagggatgtagtgacatttaataactaacttctctttcactgtttattcaaatgaaattatttccaagacctcagactcctgaaatcctagtcaaatagaaaaccagctgcttaaatgtattttgcttagttttctttcgatgatcacaacatggataattctggctgtccacattcttatcacattatttttaaacacttattatgtgatgtgctagaatgattgttttctaacacagaaaccatttctaggaaagatgtggaagatgaagagtttggtcatcattggtaataatactaaagagttttaaaacgttgtcataaaatattaaaagacatataatggtctaaattaggcccaacatgaatgtaactagtaaccttttttcctgataaatttcagaggtctcatcattctcattttcgatttgaaaaatggaaagaataatgaatagaaacagattttaaattttgccttgctctattttttttctattaagattataaaatgttagtgcgagtttatttcttgcagtgagaactatctactatgtggaggagttatgtaggtgaaaaggaaatggaagatcacttgacattttggatctgtcagaaactgctaatactataaaagcatgtggttgtttgggatgtgggtaatacacaatacaaatgctactctggtctacggggtattttgctttcaccaggctctcatctggggggaagaaaaaaacaaagagaagttgagtgaaagatcaattcatggtcttgaaacaaagatatacagacatgtgagaagaggcttttgaaagaaacatatacttattagaaatatctaccatcaatattcaagtaaatcaatcaaaatatttgtttctgttaacattaagaatgtaatcccaactctgccactactggtatgtgtcaactacaaattttcttttcagtttatttgtgtataaaatagagggagattagaagaggatgtctaagttttggttcaactctctcattttaatagaaaaagaaagcattaagttgtaaaatatgaaaagtgttatgatgaaaggtacggagtcccactctgtcgcccaggctggagtgcagtggtgcgatctcggctcactgcaagctctgcctcccgggttcatgccattctcctgcctcagcctcccgagtagctgggattacaggcgcccgccaccatgcctggctaattttttgtattttttagtagagatgtggtttcgccgtgttagtcaggatggtctcgatctcctgaccttgtgatccacccgcctcagcctcccagagtgctgggattacaggcgtgagccaccatgcctggccgatgaaaggtagtattttaagtgagtttaaagtgttttgtcttttggctgaaaaaacaaaaacaaactattttgcacgtgtttttctgctggacaaatggatactagagatgtccacacaaagaagacaccctcatagaggtttaaagattcttatcattgaacatgaggcttgctgaccaacataaagtgattttagtgtaaataatgcagcaatagttctcaaactttagtatgcatcagcatcacctgggaaggcttgttaaaatacagcctggtgggccaatgcctagactttctgatttagtaggtctgaggcggggtccaagggtgtgtatttccgtcaagttccctggtggtgctgacgctatggctgctggtccagaggccactcaatggaaaccactggaatatggcattgggagaaaggtaggtgatcttcaagatgttttttgtagtttaattttaatcgggaatttatatatatgttacatgtgtatatttatacataagtgtatatgaatatatagatatgagttagaaagctagagggttagtttggattaatcattcaataatcacatagtgtattttagctattattattgctcttattattcaagactgggagacatggataataattttgaattggggaagagttctcactaaggcactgtcatcaatatttgcaggatgtgaaaatgctaatatcattaggtgatctgtactcaaacttgaaaactaatctttggtaaaaacaaacaaaacaaaacaaaacagtttatgagacacctcacatgtctgctctgtaaacacatcaacacacacaaatgcccattttaatcttgaccacaaacaaaactcagatattggtttgtgtactatcttttaaacttcgcctttaatctgtttttttctaatgtaaacaaaatatttattttccccagaatcatcttaatgaagttactgtgtatatgtaggctttgcccatcttccacgtgccaggtattatcttttgtgtgcagccccgccctcccctcttcaacaactctgaagtctaccagtttatttttttcttactgaacattaaaggggtttgttctctattcctcacctgtcgggtttactgctccattttaatgcagcaaaaaaaggaaaaagaaaggctaaatgttagttggccaatggtaacaaggataaccatgacaaccaagatttaagaaatagtgttcacaagcaaggacacataactgacatacattcagaagcgacagcgaatcaaaatatttatagacctctgattatgaactaaacagaggacatgaagttacatcactgaatacatagtgtgtgtgtgtgtgtgtgtgtgtgtgtgtgtgtgtgaatgccacgtgcacttttatccatcacctataaaatactgccacaattaattatatcccaggaagtgttcgacagtggagagataatttgatttttaaaaaacatgctatgagaaaactaatgtactcaatgggaatacagcatcattccataaaagaaattcgttcatttaaaataaaaagccttcaattaagaggtatgtcattcctttcatgatataaaatatctgcaaattgtattgaactatacagaaatttgcacaattgaataatacaccaaaaggtaataaggtggcagaaatgatttcttcaaacacctcttgccacatcttttttcccatgaaggattaagtgcatcttcagtttaggaaaatataatacccatcattataaatctacagagcatggcccatttatacagttgggctaatccagaaaaacattttattaccagccattgacagaacatgtattttcctagtctgtggtgctgtctgtgaacacaactagttcatgcttatagatcctttcacctgtgataatatgttgattgtgtaaataaccatattatttctgcagagtataaccttttcctgaaaacaattaatctaaaaatcttcactttgaggcaaattgcaaagttttcagtgagttcccagttgcaaaataaaggtactaagtttttcttaatgccaatgaaatatatacccaagtggctggaatatctggccctgtgagataattcaatccatctcttttcaaaaataaaaaaatccacatttaaatggtacaaacacacacatacaaagtaaatgatgaaaatgatatcaaacacattggttaattcttcttattcttaattttatagtgatttacgtagtgtgccaggttaaaaagaattctatataaatgtttccaatttgctcactttttaaaatcagtgactttatcagggaatcagttgtagaaaaatctatgcctcaggatggaaaaccatctagtgaattatcagttctatgtattaaaaggctgttttgagtattcatatgcacaaattcatagttccagataaaggtcagcctcaccatacacctgggtacatatgtggtacaaatatctaagtttgaaagctttcacaactggtaaatttaaattataggccgaggattttattgcaactcttgccagccaaaataaagttgatattgagtgatggagtcaacatgtagaaggaattgagtttgtttaatactgtttgacttgtatacatttaattattcaatatttttgtgtgccaggcactctactaggcagtagcaacacaataatgaataagacagagtccttgacctgcagtttagtggaggcaaagtgccaagaaaaggggcattgacagtaacgcagtaggttctacaacagacaagtagaaagtactttaagagctcaggaaaagtgatcctaaagcagcccgaactgctagagaggggaggagaagagaggacagaaaatgaggcaggcacccagaaaggcttgatttagtaggtagcatcctagcttacttccaaaggatgagttggagttatccaagccaaaaggagtggcaggggagtgacaggaaaggcattcctaacctagggagggcctactcagaagccagaaagcagagtcaaccagcagcttccagtatggttgggtgtggccacatatttcttcatagcatctcaaaatattctggactgcatttccttgatgagggcttggaactgtatggagggttgatacagaaagagaagactaaagacacaaagcttgcagagagccagtgttggagcaggaaaaggctggaaaaactgaagcctacatttcagtctcatctagctcatggtttccacatcctgggatggggatggaaaaatagtgtgcatgcaggctagattattaccattcaaggatgttaattttgcctgaagtgcatctcagacttctaggaccacctgatctacactttctttgattccatagtatgtaataaacactttttatccatcttgaaatgcttttccatagaggtaaggttaacagtttatttttaaatgtttattttttatataaataattcttggacagttctggaataaagtctgaaaagccttacatatgtaacagatatacagaataagaactttcaattgccttgtgaattttttgttggagtagatggacgtgcagtaccaatactattatctggtgtttaatgttttcagattatagcgcattatgattaaaaaggtctaattatctggtccacccactaactttgtaatgaagaaatgtaggctcagagtgttggcatgaatttctaccccatgcaaccagctagtcacagaactgggacttggattcgggtttcttggctcctcagtccagtacttggccgaacgttgctactatcttatctctggaatgtgtattttaagtcatgggccatataatattttttcaaaattatagtacaagaaaatttataacattaaagatataccaaatatattttaattttctgatgattcagagggtattttagggatcttaccaagccctggtgatttttttttgttactgattatcaatgtattataggtatacagattactagattaaaaacaaaagttaaatgaacagaatgccagatcaaagagtatgccatttccacatgaatagatctaataggaataagtctcaaagtctcctcagacagctgggtaaaatatacttctttatatgataaaactatctgtagctacagacctattgctaatgctagcatcttagaagcagagatatatgataaagtggattatcaatataatgtgagtcaacaacgttttattctcattctcttctcaaagcagtatttgcatatgggaagtaaaatattctgacaataataataataataatactttcaattctgagtcattaccaatgacctgtatataaactgaaaggcacctaaaaagagggaatggactatttattatgtaattaactttgctcagaatccaagctataaaagacactattcattgggtacagaagatttccttttgaactgcctcatgataatcaagaaggacattgttggttctacttgaatttcaagtcaggaatgttctttactgctgaagcaagcatttctatttcagaaatgcttcatgggccttcagatggttagctaaatatacttagcattcgaggatgtgtgcatttcccaacaattgcattagacgatgcttacataggcccacactaaaatgctactctattttaacagagtcataaaacctttaaatatgatacttctttttgtgggattaggaaaaattataagtgagttgattttttaagcacttgcagatgaaggaagaaaatagttatcttttaaaaattattagggctataatcatatttcttcaaatttacatgactgattcacaaataccatatacatctgttgcttggtatgatttaatgatagctatgtatatccaaataaaacataacttaaaaataaggcattaatttttcccatttcaaataatcacaaaatgtcatgtcatatggtctagaaatacacctgtcaacaatcccttgttttttgacctactcccatagtagtatgtgactacctaaatcaatatttcccagaaaacaattagaattataccactgctttttattattgaattctcttctggaaaaaagtgcagcgtacagacagcaaaggacaccagctcctgcttggactcaaacagggtctatgattactcacggggcaggtgtgtacctcatgcttcctgcccttatctcttacatggagagaggtaataaaatacaatgggttccttaagatacatgcttatagatacagattggaatggaagattcaaatcatcaaatgagaggagattttggctttccacacttactttttcagctattttacagcacggataattgaatgatggcagtgttcatgaaaaaaaataatgatggatatatctttcattctttataactctaaaataggataggcaatttaatgggttatggttatgaacttctttcatttgtcctttattttctcaaccctctcttaatgctggaataaaatgaaatggagccttttaaaaacaagtttttcaaaagagaagagttttgaaggagtttctttttttaagagtcaagataagaggttatgggggaaaaacgttattccagggacagaagagcaagggagtgagggtgaaaataattaatataaaccccccaaaagggagctagatgggtaggaaaaagagtgaatggaaatgagattattagattaagcatgtaagcaagaatcaaaatgaagatactctttttagattctgaaggccaaggttagggacagggagagaagctatcttgtagtagaaggatgagatcaacttcacagtagcatttcaaaatataacacaccacaaggaaaacgagaacatggattaaagttttgtgaaaatacaatttggattggaaaaaaataaaaatctatataaagggaagtaattttgaatttagtcattttaaatgtttaagaaagtatattatatgctactctttataagttcatatttatattataattatattcttaagacagaaagaatttataagaacaattactaatgtcctctatctaactgactggccagtgccctaggggaaaaaatcttattagagattagatgttagaggcagaaataaaattgaaaaagagtggcatatcagaaaaatgtgggtagacacagattatttgcatcctaactgtagtcaaagacactactcaaatcaacacatgggcataataagactgagattatattttttaaaaaaggaaaatagtaccttggcatccctttttggacacatacacgaattcaccagtgcagatgtggaataagagttagaagaaaattgggagacgattcattctccatccttctcttttttttccccttccttaatccttaatttttatctgcttttgctaaattttgagaaatagctacagggagctatctcaacacttgcgcaaattagaattatgatatgtatacaaattgcaaaatcgtgatagtgtttcaaaaaacacactgaaatcgagcaattaattatctaaaacaatcaaatgaaagcttgcatggaattatttgcttgtgaatgcactaatgcctcaattgttatgaaaagtgcttatctgcataaagcagctcagaagattggaggccagaatagatgcatgttggacaacagaagtctataccaaaactgaataagattccaaatagtacagtctttacattttgatcttactgtaatgtaaacacttttccaaaaataattgaaatggcactgaagtatttctactaaaatcaaccacctaaggacagcagaacaatgatcaagtcttcaaaaataaggcagcctccaaaattacaacagaaatattgggcaaacctaccttttataaagaagaatagcaatgacaatgcagatgataaagaccactgcaaggacaggacctacaacccagatcaagccttcttcttcatccgtgattggctgcggatccagatccattgacaccacggggtcggagtaagggctggttgcatacatcttctgaggaaaagcagagtctatttcagttataaaataatgactttctagataagtacctttaacattagaagaagcaaaaaatccaggaaatagtggatttaatgataagtgtgtgatgcaatattagcaaaacagaggggaggggagaggagaataaagaaaagaaaggatggaagatgttttgtaatacaaatttccttatagagtgaactattttataataaaatcattttgatagtacaaattacttcatagacactttttattgggctttctatatggtgtattaaatgatcctatgaagcgtaaagtaccagtaattaaccagttgcaaaatgtttaatgaacatttacattgtgccaaggcgttaggtgctgtgtgaaaatcaagagaaaaactagagttctagccctcaagccattatcatacagttaaggagaccaaagtacatatttacaatgcaaaataagtcagtatttaattaaatgtgaatatcggtagtcattagtactactgtgcttcttagtgcttggtactacttaatactactgcatattagttaggaaatggaggccaaagcatgaacaaataaagtctacaatttcaaaagagaattccacagttcaaattacagatgcgagatgtacagaattgatgatatggctttataaaatatagaatttttagaacttaaaagaattcagcagttctcacttagttttattacagttattgctcagagattggtatgtttgttctcaatagacaactgataatatactttttaagaatacagttacttggagaagaaatggactaaatatcgatgatttttatttctatgatatccgatcccatttagttctgtcctattttagcctatattaggaaaacatcttcttggctctacctgcccccttcaaggccctatcttccactttccaatccaacagaaactaatccatatccactaactgccctgcttctaccactcactcctcatctcttctcactccaaaccaccattggtcctatttttttttttttcatttgccaaatctaattgcctttatttactctttacctttctagacaatttttccagatttgccttctttaaaacttttatctctggctctctcaattttgaattaaaccagtcccatcctcatctttccaactgctcatgccctgctgagttaattatctctgactccatcctatagacaaacattctttttttaaaaaaattttttttatagagatggggtctcaccatgtttcccaggctggtctcgaactcctggtctcaaacaatcctccagccttggcctcccaaagttctgagattataggtatgagccactgtggctggccctgaacccgtattcttaagttctattctctactagcatctcttgtcctctcttatctggcaaggtcagcccaagctttaactatcaacctccatgcagaatctgtctcttcattaatgttcctaaactcagatactctatgaaatcccagatcttcatttccaatcatttctagagacccctacatatatgttcaaattagtatgagtttcttaatttttcccagatccttcttcccttcctcctcacttcccaaattctctcatcctctcagtatctaagaatggatactgattttaccttacagaaaaaaggaatagaatggaaacactgatattagctaatcagtgtcccccaggtccatctgctcttcttctagtctcatgagtgccacttttctttaggcccttacttatgtgctcctaactataccaagagcttcttccttcctctcatagtctccactgctgctagaggtatcatcctaaactgcaactataaagccttcaagaggctctctcttgattcccaaataaaacgtagataacttagcatggttctcaagggcatccacaattttactttaaacttgcttacgacacacaacacattccatcacagtgggcttcttgctactactccctaaaggctctattcttgttcctcaactccctcacaagttccacaacatttagctcctgaaattgaacaactctccaggcccccacttgaatactgcctccaatgaaaccacctctttttaattgactggcagtgatcggtcattcccctctactaaaaaaaccaaaaaagataaaaataacacagctaaatttttatttagtccttgtttttttaaatggtactcaccaaactgtattttggctttttatttgtatatatacttcattttctttggcgaaactacagactcctagaaggtagggatttatatattatttgtgtttatatgcttaaagcagctagcaatgaaccttgtacttagtgggttctcagcaaatcttggctgaataagacaaaaaatgttcatcttttcaaatggctgaaattgtcaagacatcagtatatatgctcacttttcatgattggtacatatatttaaatgttttaacctgcatctttaaaaaatttagtttatggcatctattctgaatttaagtacaatgagcttggccatcaagcaggagaacagatgttccactgaatgcttgtatactactcttctctctcattttcgtcattgtgcccaggaaagagactgactagatttgcagattttctaacgcattacaagaagataaaaactcagtatatatgtccaagcttctcagaggcagccaaaaaaaaaaaaaaaaaaaaaaaaaagatgtgtatggtatgaggattgacacaaaggacttggcaaagaactatatatctaagaaacatgattttttatataattgttttggtttatgctttacccactccattttgtaggtgatgttaaaacagtttcatagacagaactaggcaatactgtctcatttgaaattctttaccaagaacctttaagataataatcacggtccattgagatggaagtctaagcacaggttttcccaaagaacatagatttccaacccattcaagaaacagagacatatgaaaatgaaaagaaaacaaaatcataaaatgataccagcctaatgaaaaatataatttcttgtgcgtggcaataagagattaaattttggataattccaaaccagttatctgacattcttaatatgagacaaaggattaggggatagcttgtgtctttgagagggacggagaagtattttctctttgcaaattaccagtctacccttggaacattgttataaactgatatggaaatttgaggcttacacaaaggctttattactgcaaaatgactctagctggatacaagtctctcctaggcctgcaaatatttatgatatataaagaaaataaatatcatagatatttgaaagcaatgctgagaaagatgatagaataaaggggcaacttcattaacaaatttggaaaaaattcttgattctgtaattaataaacagatgacatactaaagaaaggggcagactctttatcagttgtgacacatttaaaacactagcggaagacatcagaaaccacagtgtgtagttcagtggttcagtctgcaggatcgaatgagatttctcttctttgctagattctctgatctacctcaatgctctaagtatgctttttgaaatgttcctagagctattaaaagaaatttcctctcaaatatttaaaagtcatttttgaataaaagaaaaagatgatttcttaacattccattcccttgatgttctgccttaaaaccttcaactagaaagagaaagcatatctgaacattaaaattccaggaaggccattactttgttttcaaatgacattctgagcacaaaggtaaaccaggcagagaggctgcctttgtgttttgattttccacgggggaattctttcagtcacttgaagagaggccccactgtacacactaacacctgatgtggagaaatctttgatacattgtgagctgcttctatatgggaaatgactggctcaactgggttgccacacctgtcatatttagacaccgattagaaaacgaagtttataatatgtatattaaatgttcatgtgtactgccacttcaaaattcaccccctgcctatctacaatatctctcccctttttttttttaaacattcaaagtaactgaagcataaaatgacatataagcaagatggattacataaaagaagaaaactcattatttagaataccttaggaattctctcttttattaaattattttctaactttcttggcttttcactgatacagtcactcataaatttctacaattaaagaggctgctgtatttgcctctttctagatagaccttcctcatgaatccgggtagaggcactgtggtctcacttggcagatataggagaataaatacaatcacccccaaagtcagtattttcagaaatatgccatgttgaatggccaagcttgtgagttcccattgcaatcacaggggctaatgtcaaccaggtattatgcaacagtctccttttttggacaacagtcattttgaaaggatgatggaaggagattgtaagcaatgatggttctaacaccatgatatttgtgttacatcagaaggtatcaagaaccatgtcctatcgatctggaacttcataaactagagggccacctaaatttccttcatcagagacatagtctcatttgtaatgcagtctcaaggagtatattgagcaatgttcaaagagtaggcagcctgttattacacttaataacagttcatgagaaataatgaggatggatatacccacaaatccccaaataaccacattccagtgaaaatgtataagcgtaccataggaaacagatgccatcataattaacttacagactctgcatgttccattactgctaacacaaagaagacatattcttgaccactttggagttgcttgtttgtaaatccaccataatgcttgtcatcccccagggtgaactcagtgggaaggacatcaaagtgagcggcaatatatggctttaattcaacttctctcccataacggatgcttctgcgcttcctagatatctccttaagcagcttaaggaaaaaagtgggaaacagaaaaagaactgtaaataataacccagcttattgataatttaatgagataaattaattcagaactgggaacaacccaaatgcaatttgttcacatttcatatagcacatcagcatcactaaatctcagttctctcaatatttcaaatgcttctcttcctgttaaggtagaggtaagatactggactgctctgacaaggtctaggctataaacacagggcaatgaggtcctttgctgtagctcatttcatttcctacactaatgaaattctctcaaagtgcatcataacttgtctaaggaaaaaagtcagcttgattcataaaagccttgccctgcaggagatttattaaataagtattaacctcagacaaagccatctaaatctttaaatatagccacattttagaagaggttagtgccactttagattgttttgagtaatgagataactcatatgatacaaattccctcaaatcagcagaagcagaatccaataaacaatttttaatatacacatattaaatagacattgttactcatttaccaatttctgacttgacttagctccctggttaggcaattagggtgcacttccttacactttatcatggagtcaactttttctagaattgacctctcttgggagtgtgtatatattgccagataatataggcaaggtagatgaaaattaattttagtactgccctgaagaaaacacacatgcacatgtatatacagatgcttcatgtatttctaaagaaaagagatagagtttatttctggataacctattatttttcattgactccttcattacgagaaaatcatactaacagtggttatgaacactgatttcaaagttacctttgacttctccaattaaaattggtatttcacagggtttaacaagggaaaggtctgtattagtctgggatgcctgttgatgtaagcagcagtcttttcgccattttcttgggaagaatttttattttatttattttaatatctatgtattaatagaaaagtctatgtatttgaggacaaactggaaaaaggaatgaaccttgtcttcaccttgataaacaaaattaagatacttatggaaacagtgcagcaaaactatttactagccctgtttttgtaaatagaaatgatctagtaagaaccaaagtgtgatctctacttagtagaatgagagcctggcatgatcaaggctaggcttctgtgataaaatggcttcagactgtatatatgataaacactgaattcttccattaggaatttgatcgtacgttacagtccctcctacactgggagtagtaaatgtgttcagctggttcaaaattgtatcctaaaaatgtaaaaaaccagtttttcagttacaggaaaattttggccgacattatttttcaataatatttaatttataacgtgctaaaattttctgtgaatttaagtttattgatgcaattaaaattacatgaaatgtaagctgttttaggaaaaccacggtagattgggcatcacttgtttagcaaaattggaccatcccataataaattcagttatgctgatcaattatgcaccaattggccagtaaaaacacaaggccagaaaggtagcactatcttttaatcttgttgtcaaatttagctttacttataatactgataattataacaataatagttttcatttattaagcaattactgagtgccagacactgttctagggatcctaaacatgcattagctccaatttactcctcgtaataaccctataaggatggctaatattatcctcattttataaatgaggaaactgaggcacaatagaagaaagtctcaatatataattagactcaattactgaaataaaatgaaattccatgttagagattttttcaactataatgtaatttacttaatgattacacaatatcataaggaaatataatgtttaagctctgatactctaaattgttctaactctgtgtatttatacatataatttttatgtatctgcttacatcaaggcagatgaatgtattatttcttttttcttgattcttttcatatgctaattaaaaaaaatccgataccaaatatttaatgaagtattataattgaagcatcattacacagcttattgttgatatgtagttaaggacagtagcctattacaccaagaaggaaaatgcactgcagaggtgctgaacagtttttgaagctgggtaatcaaaaacattcatcatgagttgtttatgtgactgtgtcccctcttctacttcactgatcaaaccctaccttggttttattcatactgcagatgtagttaatagtcgcaattcatccatatcattgtcattcccacaagcactttctgctagggtttctttagaagacttataggaagtaattcacaataaaatatttgagcttttgggtattcttagacccaatgcagtcattcattaaagtcaaacctggagcatcactctgcccctttaggttgctctaatctctgcaggatgcttcctgtgttacacgttaaatggttcaaatgggctcagatgacaccaaagtcagccagcatgttgcagttacaaccacaaatgaccacattattttacaacaagcctttgaagtacaatgcagtgaaaagctcatgatctattacatgacctgctctgaattaaatatcactaacattctgggagtcattctgccccaaattcattttgactatcaatgtctgctctacccagtttgaccttgacaataggagtttcagtttataaatgtatcatgtggagagcagcccggtaacaaaggataaatgaactcagaagataattttgagagtaatgctgtttggaaagcctctttcaatttcttatgggcctagatatgaggtatacgtgtggaaatccccttaggccaccattctattcaatgatatggttccaacaatttgaattataggcctttctgaaaaattacttgatcaaatacatttaagagaggaacactgctttgtcaaacctggcagtatcaagctatagataaaattactacagtgcttttattatccatggtagaaaaaaaaaaaaaaaaaaactctctgtagggatcaaaaactggatgagtaagcataaagtgaggccatagcctactttcatttgttcccctccacaatggttacaagatgtactggaggtaattccagaagatatatcaagggctttagttctttatcagaaataattttcattttccagtcaatgcatatcttatttcttccaccattaattctacaatgtggtctcaattatatcagtaagaaaagtgggaaacaacccatcccgacccaaaaattttgaattaataaaatgttctttatcaaaccattatacagattaatgcaccacaacttggatgattaaaatgaccctttgttatgggaatcagcagcggagacccacagaatttaattgcaagaaagttcaaagtcatatagccctatactttaatccattagtgttgctgtgcattttggaggttaaaacctggctacaaaagagaatcactttctattacttactaccaaacggctttacttctaaggaaagcttattagttaaaactatttgatgtcattctggcttggatctcagtgccttaaaaacttttttttaataggtagaacaattcatagattctacaagttgcctttgcattttaaattccatttcaacttaaacaggatgatgacacttctgtagttcagctgagaaccaattaaaatagtaaagaatatatcaagattaattgattagtcagttgcaagtaaaatcatgtttggcttcaaaatgcttagaaaagagcagctgatcattctgcattttcagttaaaggattactattttctgaatatcacagaataatgattttgttccttcaccatcaaaacaaaacaattaaattataacatatctaaattacttgatgacattattgaaataatgtctcattttacacagctccaatgatcatctaatcactagtgacacaaaagcataggcctaaccttgaactcatctcctcgtctgaacacgatcaaatttaattcagataaatgaagccagtgatcataaatcccgcttctagagatgacacacgtctgccaaagaaagctaacaacctttctggtcagatcacagtctcctttgtgcagacatagatatgaaataagcatcatctctctgtaatgtaggtagggaatttattcttttccttgctctgtttgtactaatttgaggtagaagaaatacctagaaataaaagattgtactacaagatgtggcctatgctataaataatcccaataaattaaaatctcatatttgccaaatgggggcgttacggttatttgccttatgaactgattgaaaacagcatcatgttaaaataacaaaggctcttctgtattttaaaatgtgaattctactcattaacttgctgtggtcctctggggatctagctcaacacttctggatcatattttcttgcctaaatagaagtatgtagtaattatgtcttgttcttcatgttatgcattacctttcaaaaatgtccttatacaagaagagtaccaattataatgcacctgctgttgcaagattttggaaatccacgttatatatttagtatttgttgtttcttattctatatattctgctttgctcacaattttgtcatttgttttctctatagttaaatgcatttttgactctgaaaacctacagaatatagaacaaggcaaacatctgataatcaacagaattctgtgagaaactggttaagaccatatcgtaggtcaaatgaactctgctgcaaattgcaacttggtgtttgtgacagcctcagcaactgttgcactaatgaaggggaccttgggatttataccaatggtgattaagtctttgctgacaattcacttcaccttccacacctctacatcatgttttacaaggagcaaggggcaaaatgttaaggccaacaaagattagacaggttgtaagctttattgcagcttaatgttttttaattaaagccaaaggatctttgttgggatccccaggggttagcatgcccatagcactgaaccatccaaccagctaggtatggagaagccagcacccagattagatcctgaaaggcctccaagggaggggggcggaaatgcagcagattaaataacgaataaaagacatggccaacaatgacacagttacctcatctaattccatttcatctggactctcccatggcttgataaatttcccgcgagatttcttcaaaggcacaattattatgtagtaacctctgcacaagaatgaatagataaaagttaggttagttgaaaggaggaaaacgtggatatacccttaaaccttccacagaccaatgaggttgaaggcaaattatggatatggggtgacttgtccatttcttacatcaatgacaaatatccacctgtttgttcaattttaaaaacaacacgggaagacatttatgtgtgattgcagtgatcttgtatggtaatatcatcatggtggactgctctttattaggtatcataaacagagcaggcatagtttgttagggccctggtgctggacacatacaaggctagaatactgcaatctaccaccacaagctgctgaaccaaatattttctatgacatgaatttataagaagatgtttttaaaaggaggatatagatgaaaaatttcactcttagcccacataaatacctagtagtgctgttgtttatacaaacctaaaatgctttttatttgaattaaaaatttttaagtaacaaaaattaggtataattgcacagagtaagatattaaaaattcccttctttttctacccatcaaattgcaaatctcgaggtaagtaccgcagaaaattggagaaaatcacgacttaagggccttcaaaacagctatcactataatgacatctatacgaaaagacaaaagtaactgaatacttacactgagaacagtcaactaaaatttaaggaatgtataaaggcacccatccacaaataggtatgggttatttgtaaagctgttttgtcacttcagtctagtatatactctgctttcatattcctgtttagggattctgctcatactgatctttagtagtaactatacaaggactttgaacatactgtttaataataacatattaatcacttcctacttctcaggtattatagtaaatgcataatctggttttgtcctcctacagagaaattctctgagcaaagcctaggtatagcctataaggctacaaggactggtcacaggcaaaaagacagatctgtagagattaaataattgccaaattaaaacagatagtaatgggacgcaaagctacatttatcttaatggtggcagtggtctgtctctttttcttatttactctatgtgtcataaagtattttctaaggactccatacacttcgtggagatttactgtgaaaatgaaaacacacacacacggacctaaacatacccccatacctttaaaagaggaggccaccacacaggacaaagaaacaagaggaaggacactcccaaccctgtgtcacactgaatcacagagaccaatcacagagaccacagaggccagcaaggcctctttctattcatctcaaagcaaaacctgtaataaactcagtaaactctctgtgattaagaactctgtttccattaagagtctagagcagagctgttcagcatggtatccactagcccctgggggccatcgggcactgccaatgtcactagcccaaactgggacgcactgtaaatgtaaaagacatattgcatttcaaagacttagcattaaaaagagtgtgaaatatctcagtaataatttttaaaataatgatacattataaaataatctggatgtattaggttaaataaaataaattattaaaattaatttcacctgctttttattttttcactgttgctactagaaaacttaaaatgtcacatgtgactttcattatatttgctggacggcactgctctagagcattctggtgaagaatatggcacttggagatatgtctggctgggagtttgggctgatctttggcttagaccccagaatctgttatatattctgaaatacgtgagtaaaaaataccaggctgtgatatggggggaaataaaccagaggtgctcagcacagtgtgtgtggcatgtagcagtaaacagataccagctgctactggctagtatgaacatcacaggccggagagacgcatctgaactatcttattcagtaagactgcatgaaattccgtgagctgcaggttaaagagcttgtcaaacttcttttcccctaatggagaattcaactcaaaccagacaactataccacaatgctttctccatggtgccctgagcaactaatcaacagatacacaggattacaccagctagccattcattttctttactacaaacaatcataatgatcaaggaggatgaggagaaggcagaggcttctctgcgtatgacagagaccaatatcttttatgttatgatccagagtaagcttccccctctcctgtcctcccaccatctgaaggatttaccgaacaagtccatcatgttaaatgagcatggaggagaatgacagaggctgcaactgagcgtacaaaatcacactgcagatgtgcttgataaacacacttgtcaaggaacctcttgcttttcactaccaacttctcaaagtcagaagagcgctacacataaagcaatgatactgcatattatcagagtgctaccattgtcctccttcagaatcttgtaaatcaaggttaagctgatgagtttcattaattttttcttctgctttcatactttgagttgccattcttgtacatgaaaaaaaaaatccattctttcttcggcagcactcccccactattcattttacttgtggctgggataagaattgaacagcctcccccacggcaattaattaacggtgcggcaagatatccacaaccttttttctccgctgatctctaaagcattcatctagggcagtcaaagtgaagcttgcttcaaagcagctcttgcacattgaaagaaatagggcagtggcaatttgaaattctgtatcatacaaagcctcacctcagtctaaatccacacatttcaactgtgctctctgcaactatagctttgtaaatatcaacttccttgccttacccgcaacctgtctctcccctgagggtactgcttcctttgcagccttctcatatggcagctgtggatctatccctcctcccctgcccatgaacctcagagtcagggtttggggtttctttcctggcttcccatcgcttcctgcaggtatttttcttccactctcttgcttttgtagtaacaaaccccttcttttttgaagttcatgcaatccagctacattatgatcttctctggctgatttttgccatctagtacctcccccagcatctcctttctctcagggaagattcttttgcggggttcatggccttcttttttctccaaactctgtcatcatcctgggtgatttcaaccttcataggtcgggcccacgtaccactgaagctctcagattcttcaattctccctttccaaagcccgtctcctccactctaccttagctgaaatctacgcttgccattctctgtgccagaatccagggagctgaacacagcttgagaaataaagcacagggcagaataatgccataaattcataatcagcaaccccagttaggccttcaacacggcctggcaatcttaccactatctagtttcctaataactgctccaattgcctagtccttccattttccacagtaacattttcactttctcctctagcctgaaaccctggacgttcaaaccaccccactagaagatggcctcatctcttatataaagagaaaatgcaaagattcagacaagaattccctcatcatctgtctaccaaagtacaagtctatctagatctgtaaacaaaccacacattttcttttggtaaagtagaagggctggccctacttttgaaggccattaactatttcttgaattgttttcaatcttctcactttcttaggaagtttaccatacattgtactccttctctctcatatatctcaacttctccttccccatttgatcccatcacttaggtttcaaccatgtacaaatatgtgtcatatagagaacaaaacaaaccacatcccactctagtcacctctctttctcccactcctgactgccaaaattctgcaaatagctgtgtgttcctgctgctcccactgcctccctttcccttcacttcccagctgactaggctttagcgcctgcctcctcactccacctcactgccattgccagggtgctcagtgatctccagggcattacatcaaaaggggagtttctggtactcttctgtccttcttgccctcttagcagaccttttaagatgttaacactctccatgaaacattctgagccctttctctgtgatattcttctgttatttctatgtatatctccttccacactaaccttatttccttagcagaatttatcatctgcggcccagctacaatggtgacactcctcaaggctctggccaagaacttctatccagaccctattttcatcctagatctcattccacctcagggcatcagttcttagctatatgcaaatgatttccagactcatatctttagccaagaatgttcttctgaattccactggtttatctgactttaagttacaaaagtacccccaatttactgtggttaaaataaaagaaataatatgcctttcaaaataaaccctccctaacattgcactacaatccatttcagtgcacaagccagaaacctaggtgttatcattgacaatctgcctttattctctccctctgtcatacttaatctattgctaagttctatcacttccaaaccctatctccagtgcacgtgcttttctccatctctactgccactcttctggcctcattccatgtcttatgcccagactgtgaccttactctctcaactctctctattgactttagccccgtctagtgcagtctctgaaattttcaattcacaatacaaaatttgttctgccatttccactttttaaaacatttcaatggatcctcatttctcttaggataaagactgaaaggtatcagaaggccagcaggatcttgcctgaatccctctgactgtgccctctcagctacagcttgataggctttcagtttcttgcatttaccctagtccagtggttccgagcctttttggcaccaaggactgattttatggaagaaaatttttccacggacagggtggggattggggggatggttttgagatgaaactgttccacctcagatcatcaggcattagattctcataaagagccggcaacctaaatccctcacatgtgcagttcacaatagggttcatgttcctgagagattctaatgccaccactgatctgacaggaggcggagctcgctccagtggtaatgctccctccccactgcttacctcctgctgtgtggtcgggttcctaacaaggttaggaattggcacccattcatggcccaggggttggagatctctgacagtccattctgtcattaaactatcgatcattctgttccacctgcctagaactttctgtcactcccacctagttaactattctctctccttaaatatctactaactgattattttctaagtgaaatcttctctgattttttttaaacctattacccccattatatggtctctatgaaccatttttaatctatacattttcttatacaacaaatttatatatttataaaaacattactaaagcagacatacatataatacccccaacatttgcttaactttgctattttatcatggaattattcttccactgtaaagaaagtgggtacaagaggtggctcttaggaattaatgcctctcctaagtcaggcagtcaaaaatatttggcggttcttctccatcagaattttcaactctcagtctcatcaagctttttctcctttcttcaaaccagcaatggcatgcccaaatagagtttctagaaaatataactccttattgcaaacgttcttttctttactggcctactcgtgacccttgttctaatctcacaggacattaagaaagataagatgattcatattggaggagtgaaatgggcagctaatatgtgccctacaaattcatatcaaccaaatcatatgagctgaaagaacttgcttgaaatgaaaaaaaaaaaaataaattgcttttggagctagctttatatatgggtaaaattaaactcaatattctgctttgcccgtctgcctcaagcctggagtttagactcaaaacagcttttcaacatagactttaactattaaagtaatagaaaaataaataacttcagaatcaatatatctggaaagcccttgactacttataaagtaagctgtgttttcccagtatattagatttaattagataagttaaatctaaccttcagagttttaattatattaagtaaagttttactgatttcatttaatatgttatcatcaaggggcccagttccccataattatatgagaaggcaagctctggtttttgtggcagtcccacttcaaattcagtcaggctttttgtgttagtgtgtattagcattctcaaacatgttatttaactgggaggtgaaaagtccgtctaggagtttaatgatgaatgtcattccttgcgtaagcctcctggctttaccgctccttaaattctcatggcaacccactgactttattgcttcatgacactaaacacacacttctgtgatctgtacccaagcacatatgcctggtcactcttagttctaaggtttgtctggggcagtcctgtttatgtctacttcttttggagttttaatcagttatcaattgacctaggaaaaaaaaaaattctattttgaccaataaacttatgggcacagaggcagggctgtggttcagaacataggctctggagccagactgcctggattcaagcctttcctctctggttttgtattgccagctggggcaagtcactgtatgttgtgtgttcctcagctataaaataaggagcaccattcctgtgaggattacatcagttaatgtgtgtaacatcctttgcaaagcacctagtatgccctctgttcgtattaaccattactagtattagctgtatgatcttggccaggacacttagtaccattggtcctcattttactcatatgtaaattagaggaagaatacctacctcacagggttattgtgagtcttaaatgaaacctaatatcctcagtaaattgcaaagtactatacaaatttaagcctttgtgagttaaagtaatttaactcacaaacacatgattaattactcttcattaggctgctaatagtggaacacaaatcttatgaagcaacactgtaagccatgcttccacaaaaatcttcttgtttaaaagaaaaagttgagaacaaattagtaagaccaaagaaattgaaaatttcatagaatacccttattctttatttcaattttttataaacataaaacggttgttataaaattaatttacattgagtaccttctggtagttttttctcctagtataatctgtgttgtgcattttttaaatacccagagtaaaattctgctctataaagtcacagaagttccctatgtcattacaacttgcttctgaacaacagtagcactgctagatctgactggcattctgctccccaaatctacttaaatagtaggtttaagcaccacagaattcctgataccagaacttgcagtatccttaaggctgttacaaaagaaatttagcctttctgtgagggaactctcctgatgtggcacacaaaaaatacaacaaccaagtatgaaagtaaagagatattaaattaattagaaatcattagacactttttcggtgttgaggagttaaggagtaggggccaagacctcctcattaacttggccagaaatgacagcatggtttctgttggtcaagaaaacaggtgtcaatcaccaaaactgcattttgcttgaaaacaaataggaagcatttttctggatagctttcatctaaataaaagttagcaacctgcccaccgttctggaatgagttctgtttcttcctcacattttttctaatagaatactgaataaaaagctacaacctttcctaatttctaaacttgccaaccacggcaagtgacacagcatggcacggagcttcttgtaatacctgaccgtgttacattaaccagtctagaaaacaggagtagtaaccttacactattatccctttaagaattccaataaatagaaatcatctaaggcttttcactacaagatttgcttttcattttccatttctttgatacttttctcactcaagtactttcctgatttagtctttcactcatttcttccccaaagtggctgtaatatatttctgagaatcttttattcattcctagaaaacaaaaaatgtccaaaatagtttgctttctttttctgctttgtaatggtctcatttctgtgatgtcaaagttttataccttttccctgactcccttttcaaatatagaagcggaaagtgcataaataaaacaaaaaaaattgaacaagctaaaaataaaaactgacaaaggtagaaaacattctgcaatattctcaactccttcagaaattggaaaatgaaactaaagtttaccaccaatggactaaaagtgccaatttccaataatagctaacacattctagcaacacaatttggtgaacagcctctaaaaggtcatttttatataaataaaagaaagtattgaaaactaaattaatagtaaatgctgaagaatatactatactattttcctctttcaactgctcttttcctgaagagacatgcatgtttttttaatggaatgaatttatagtctatcatttccctgttccttcattatttgtaactttttcacctttcttaaatctttctcacactatcagactcagattagatatgatctccttcaggaggcctcccctgacacccaaattgggctaaaacttgatatttatgttttcacaatacctggcagtactcaccccattatattcacattatctattttctgaatctattctcttactataaggtaggacttaatctcagtcatctttctattcccagaaatagtcctgacaaaacagtgtgtatagaatatatatttgttggatgccagcaggaaagtcttaagaggtagacaagtacaacgtggccaaacaacaattgctagtctttctcttgcctctacaccatcagagacgctctatcctctgagtgaacggctgtctctccactcccactcccatggcccagctaacttcctgtcactttttaagcctcagcttaaaaagcctcatttgtcactttctctaggactgctgaactaataagccggagttaggagcctcgtctacagcctcccttatctatctaattttctctactataggactctgcttcagtgaactctttgcttgtccaaattgcccaattaactatgctgtatgagaacaatgagaaaggacacactgtcgctactgaatccctgaaacattaacgttgactattagggtatgtgatcaagaaataactgatatgtctatggccttgatggttttataggtaaatacgtatccccaaactcattgagttgtatacattaaatctgcacagtttcttacatatcaattatatttcaataaagtggttttaaaaattcataaatatcctttatctgtcaagatcaattaataaacattcagaatgaatacacaaatcaaggaatataatcccgctgtcatactgaaattgcttgggataaaaattacacaaatactccattctcattttcagatttctagataatagaagaagggccgggcgccgtggctcacgcctgtaaccccagcactttgggaggctgaggggttggatcacgaggtcaggagatcgagaccaacctggctaacatggtgaaatcccatttctactaaaaatacaaaaagattagccaggcgtggtggtgggctcctgtagtcacagccgctcgagaggctgaggcaggagaatgacctgaacccagaaggcggagcttgcagtgagcagagatggcgccactgcacgccggcctgggcaacagagttagactccgtctcaaaaaaaaaaaaaaaaaaaaaaaaaaataagagtagacaaatgtgaagactttattttacactgaatttattttgggaataatgttttagaaattcttttcactgaatttattttagtaataatctttcagaaattcttttcactgattttagtaataatctttttgaaattctgtcacctagttgaaattcatcaattattttatcaaataaacaataattgaaagtgtacccaggaaaggttgttttaggatgtgtatcaggtctgaatttattaattatacctaaattacacaaattatactattttaaaacttcttatttctgattttgttttttaatacctgattttctcagccatctgctttaagttttctggagtttggggagtttttgaccactttttgaatttttctccttctagaaaatccctttgccatgctgctctggctcagttctcctgttagatttctaataatccctctctgtgtcctctactggctctcttcttcctattaacggagacctttattttagtcttttgcttcacattttcccctcattgcttcaatgattctgtcttcttccacgaaaccattgctattttgttaacaactcctaaatgcatatctataatctgttttgttttgttttgttttttgagacggagtatacctctgttgctcaggctgaagtgcagtggcacaatcttgactcactgtaatctccacctcccaggttcaagcgattctcccgcctcagtctcctgagtagctgggattacaggcatgcgccaccatgcccggctaattgttgtattttcagtagagacggggttttgccattttggtcagtctggtctcgaactcctgaccttgtgatctgcccgcctcggcctcccaaagtgctgggattacaggcatgagccaccatgcctggccatctttaatcttaataacttctctaagcccacacttctaactaggtatttcactgatatttcatattaatacacacaacgttaaactcatttacttctgaatttttttatcctttaggatgacaccatcattcattgtcatccaagctcagaactcagagccatattttactctcttgatctcatcattaaagcagctaccaataatgtatgctgtactactactctagtgtaactcatgtctacctctgcatcctacttccatcatcatcatcttcctttagaatcttgttatttgcctagagtcaactatgtgaccacctcccaataattttctctaccactatctctatggcgctcccatctatccaaattccaacaatgcatgaactatgaataaatgcctctctgcttgaccttcaaacctggcatagcaagtttcacctaaacttgagggtgtgagatagaagaaatgagaaaggatttattcttattccaaacaggtagcacaatagatgctcaacaaatatttcctaaaatggaattttattatgtattattgaaatgttatcatgccactctcctgtgtaaagagctgtaatgggttgccattgtctagaggatatagttttcacttctgggtatacccttggctcttgtatgcctccttcttccttctcttgccacttgtggccaggcgctctgggatccagccgtatggcaccactgggtgcctttagtaatgggcctatgcacttaccactccctttgcatatagtctctcttttattatttgtatgcctcctatttatcccttaagatttaagttcagaaactttattgacccattctgaattagctgctcttaagataaagcataattctatcattaacgcttactacatctgtctgtttctctgtatctctctcactctatggtaaggtctttgaagtcaggaatccatctttttttattccccggagtctaccacagtacttgtagttcatatattttggtgaaaatacttttttcttctattagttattcaaccaactagctatatgtccttggacaaacttatttaattgactggatttaattttccacttcaggcctgttggcctctatgctgtgctacattcaaaccagaaaacttgaattttctaatgtttatattttttccaatgtcatttttaactttaactttttggaatttttcctacttttaatacatcagtgtcatataccattatctaatttccccccctttttttcaaccttttagtactttgtaagacttcttcataattacaaaaatattttgccaaatattagagttaatcacctattcaccttattccataaactatgacataaaatgctttgtagtagccgggcgcggtggctcatgcctataatcctagcactttgggaggctgaggtaggtggatcacaaggtcaggagattgagaccatccaggctaacacggtgaaacccggtctctactaaaaatacaaaaaattagccagacatggcgacaggtgcctgtaatcccagctactcaggaggctgaggcaatcccagctacttgtgacgctgaggcaagggaatctcttgaacccgggaggtggaggttgcagtgagccgagatcgcgccactgcactccagcctgggtgacagggcgagactccgtctcaaaacaaaaacaaaaacaaaaacaaaaacaaacaaacaaacaaacaaacaaaaagctttgtagtaagaaccatgttctatatgtttttctgtttctcctaaataacactgtccctgcaatacagattaaaaactcactgttaaattaatgaaaatctgtgttacaatgaatactaggacacgttgtaaaagaactcggatagcaaaactgggagtctgagcagaagaatctttcactacattaagcagtatcttcttttacgacctctataattttgagatataatgttcctatttacctataattctttccttcagccctaagccttcaatcaacttactttatattctcatttgcaggtacttcaggcagttgcacagtaatcatgccatccaagttggtcttcccaatgaaggcaggcttggtacgtaatacatctggtgcagtctttgccgtgaccctgtgctgcagcccaccagcactgtttccacgatttgtcagcacaaatgaatatgatttctcaggcttcaggttgacaattaacttctgtgtggctcggccatccacttcttctaccattttcccatcatcataaagaatctaaagagataaaaccaataaaaaaaaaatctggttatcagagaggcaaaatatattttctaaaccaatgtgcactagcttttggaaaatgtatatatagtcaattctaattttaggtgatttctaagtccatgagtagtcataattctggagatcacatcaattttcctgtcatttcctactgtgtaatgataaaatgtttccaagtctatcaaaaatacacaaagatagatatatacatatatatatatagaaaataacttatcaatattagacctgtcagttgtatgtgatcttaatggaatatgtgcagaaaagctctacgtttcaacgtattatgaatattgcctattttctaaaggttttggttcctctttctaaatatacttttactttcaaaaatgtttctctatttcttatttcataaatatgtacttgctaacatctcttaatggcaagccagagtttaaaatgtgccaagaatacaggccaacaaacaaattcagaaactcccagggtattataatataaataggtagaaaccatgtaaatttcattctctggctgaaaaacaaaagcactagcttagatgtaaaaagttcaagttcaaagtagtaggtaacctacaagtgatgccagccctggatttaagctcctgctccttcttcagagtgtaaaggacacacttacaaagcaccaaactgtctcccatgtgaaagtcacaaatgaaaatagcaaggacacgtggccaaaacaaagtggtctgcttgctgtgcaaataacttacccagataaactgtcccctctacttttatctgtgatttcttacaaattagaaaacaacttactttgaaaggcatggcggagttataattctctggaatctcccaagacagcaacacggaagtcttcattactgctttgacatgaaaattttttgcaaacactgctggaaaaggaaaaacagtgtatttaaactattcttaaaacagatgacctgtcctttccaccatggaccataggggcttatgctagatgctgtctactttgatcagagagagaagtatgattttcctacctgtttagagcattcattttaataccccattctcacagagatctttcctttctctccaattcagccaactctattgtgttttccttacctgaggacattggggtgctgtcagccagacttgcttgacattctataactgaaatctaaggcatccaagacgtagtaagttttacatactttacctttttgtttttgctgaacctattaatatgaatgggctgatcagttattatagcttcaaaatactgatttccaaagactgacaatcctttaaaggaggaaggccgtaagcagacaaatcctaccttgatccacaggcagtgtcctgaactggacactgggactatatggcccgggccctttgctcgtatgagcacgtacttttacatcgtatgtggtatctggttttaagccagtgagtgtcatagtggtgtcagctggaacaataagctgctccatcgggagaagggggatgttgatatccctataaagaagggtatacttggtgataatgccatttctctctgccaggacaggtggttgccaagataactggacggaggttgaagtggtgccttctgagtgaaggttttgagggaatccagttggtacttcttctggaatggaaatctccttcaccatctcctccccaaagcccactttgtttctggctgagagcctgaagacgtatgatgctcccttgtggatgtctgtagctgtaaagtgatcttctttttcagagaactcaagagtagtaagtggctccatatccttgcggccaaattttagacggtagccctgaagaggtccaaatgtgtccaccggagggtgccactgaataagagcagtattcatctgagtgtggttaatcacaagccgaggtttccctggaactggagcacatgggatggagtggtaagaccaaccaatctgaacgttcacatttcagtcattgccaaatgagggagttccactctactggtattcccattttcttacttaccaaaacaaaacaaaacaggcaatgtttgacctacatacctttgtggaaatatgctccttgtcttactttattaaagtaggctgagatactagaatttgataatggacacaaaacagaaattatcattgaaacaacagcttaaggggatttttttgacacctgcacgttttaaaccttcacacataaaggttcatatcaaagataaattaatttgagcaaagatcagccaattagatatggctaataagaataactataatgattatttattcgttgaatatgtgcaatgtaccggcgtcacgctaagtgcattgcatatagtattcacaattggtttacattcctgactcctcactacattctcggattagttattattatctctatcttctataatgagaaaatgaggcccagagaggtagaaaactttccaaggctagcatgtaacaagtgagaaatctataaggcaaacccacctctgtctggagtcgactgcttaaatgcttaattgtgctgctatgttgcttaaaagtttaaaaaaaaaccaaactacaaaataatatcgtattgacttactatgaatttaatttgcactttctaactttactatccacatcattcatcaagttcttcatctgtaaaatgggaattatattaagagctattttatattgttcttatgaataataaatgaggaaattcatgtaaaagtcttagcatgaggttctgcattctatcaatattaaccataattattaataatctgaatattaaacttcttatggtgaaaggctagcttccaatgaatacataatttatttacctttaagttagatatgtgaaaaggtctaatctactcattcaatgtattattatgtctgtatttatttttaatggagagcaattattattggaatccacagtgaaagacattgagggatgatcatcagaataaaaactaaaccaagttaacagaaagaagaagaaaggccaagtatggtggctcatgtctataatcccagcactttgggagctgaggtgggaggactgcttgagcccaagagttcaaaaccagcggctgggtgtggtggctcacaccagtaatcccagcactttgggaagcagtggatcacctgaggttgggagtttgagaccagcctgaccaacatggagaaaccctgtctctacaaaaaacacaaaaatagccaggtgtggtggtgcatgcctgtaatcccagctactcgggaggctgaggcaggagcatcacttgaacccgggaggcagaggttgcagtgagccgagatcatgccactgcactccagcctgggcaacaagagcaaattccgtctcaaaaacaaacaaacaaacaaacaaacaaacagcttggcaacatagcaagaccttatctctacggggggaggggggaaggcatggtgtcacatgtctgtagtcttagccactcagggggctgaggtgggagaattgcttgagccaaagagtttgaggctgcagtgagctatgatcacaccattgctgtccagcctgagtgacagtgaaactgtgcctcaaaattatgaatgtgaagaaaaagaaagatggtaggaaaggaggaaagcttacagtaatgggaaacaggtgataaaaaatcataccatggggatatagatgaaggtaaaaaaatcactaaaaagattatgagacaatacatagaatattaacctcagagatggactgattagcctcttcattttgtatttcagaaagtgaaacccaagtggagatgtgctctgctctaagaaatatcattaagatatttatttccttaaccaatggagcaacagttttgtttcacatgctgggaagattcatcacatgctgatataactcagctaatctacaatgtatgaaaacaatagtttctaaagtttttagataaataattattcaacaacatgtgtgctgtgttatacatataaaacatgtgtgttgtgttgtatatataaaacatgtgtgttgtgttgtatatataaaacatgtgtgttgaaggtaggcccaggaaccacatcattgtgtactcattgtgttcctcaggaaaaatgcatccagagatcttaacgaccaacacacactctcagaacaccacccatccataagttggaaactgtgtgaactattccacttgcttttaatatatttacaattatcttaattttaaaatagtactttaatgtagggacattggcagacatctttaattcccctttatgtgtatagagcatttacatgatttgtccaaatgtcagtgatggtgtcaaggattaaacacctgagtctctgctgagaaaaatccatggtgaaatagagctttcaacagagaatacagccttcaatatatgaaactccgttgaaacgagtgggtggaaacacaactattaattctcaatattctccagaggcaacagattaaacatatttattaaaattttttgaaattctagttccaacgaactgcataataatatatacaccgtgtatcctgtttccgtgagatgcacgtaaagctaggataaataaaaataattttttgatctaaaccacaaatagagactgcattctaatatttgtcatttatgagcatgttcttagtaactgatgtttcactttataatattgctatggtacacatttggataaatctaatgggctggcaaagtctaggaaaaaacccactgactttgtagatgtatacatttactcttctgtgggagttaaagcttaggatggagtaatctcttttgtttttgatgttggcatgacctttcttatcctgggacagaaaggcttgttggctaggaatcacgagatcaaagtaatgatatagaaataagagcattagctctgacctactggcttcccctgctgtacaggaggatctcagtctgctctctattgccaaacccacaacagtcattccttccctgggcagaagttttactaagcctgaaaactatgagacaaccagcctggaagtgccacaaagcataaaggaaggactcagtaaagaaatgaatgcttatgcagcttggggaagaacacccaatatcacctcaggagaggctggccacatgaagggtcacacgaagcgatgcctaaaatttccataagcatgtgaataatagaaacagtaaatgcagtttaaacaggctggagtaagggtttgggacagttgtggtattttatccagggaatcaggataggataaaaaagggaaaaggaatgaggagagttctacatcattgaatacatagttaaaaagaattctcccaaactccacagattggcaatggaactcactgcattcctggcttccagaaacactataggtatcaaacatttaccaacaattcactttgtgcaaatacttgtacactggcacacaggtagttgagtgaggaaataaagacggatgcagcagggtccatgttctctaatacaggcatattctagttgggaaaataatcaggtggaatagattgtgcaatctgtggagtcaggtttctaatgccttagggttattctgtagactacttttataagtcatgccagctgttggttcaatggttctgctcactccagcactggagcttgagggttggtaagatgaaagggtcttaaataattactcaggggagttggaaggtcatttttcagcagggtcttaatgaacacattggaagaagcagagaaggtccagttacaaagtaaataactctaaaacttacgtcatgacatataaactcttctcccttttacattttcttattctcttacattcttttaaaaatttcctaggacttcagaattggtacgtatgtgtggttgccctttactttttagcaattggaatcattggagatcaaccgaggtactcagtcccagtggctctaaatttagccccaatttaaactagtaccaacgcaacaacaatcacaattgactagacttgggctaatatttccaaattctccctgtcacagtcatcttttgattatccttaaacatagctgttcaatatagtactgaaattcatgtaaaaatatacagaaaatgtcaaaccaatgaattttctgtttgcctttaacctcaagaactcagacagtaaactaattattacaatacagaataatgggaggattaacaaagaaaatacaaatatttcataagcattgaaacataagagccaacattttcttcagaagcatccttgaggttatatgaatcttacgtagattacttaaattatgatcagtactcgtttccaagatatgattctttacaggttgtagaaacaaggtataataaacaaatatcccacaatcaggaagtttactattaaaataaaatttcacaagaattcctgaattctttgtgggagctgtaactaaatacctttacaattatggttattaggagctcacatctgtgagataaactcagtaattcttcacagtcacataaatatacgaggatttttaatacagtagacaaaacaaattgatatattcactaattgcctagggataaaccatgagtagcggctgcttatgcaaaggaaaactagagcttcgctcttaaaggaattaaatttggattcttctgccttcttcccagatgcagtggggaggtcttacaaaagtaaacgtgtaggcatctaaattacaagcattttctatctcaataccgaagcctctattgattaagaaggatctaaaattgtgaatgaaaattccaaaggaattctatatgtgaataagttccaaaattctaaaatgtctactgcatggtaaataaaaagggatgagctagccttagtgacgttaaaatagacaaaatcattcctttctctaaaattcatattcctcggctataaatccactactttcttgtcatcataacatgaccccatttaatgggcaacaggggagtggtgcttcatataaaacatttcagagttattatgacatatttataagtgtaggtaaataaaatgtattttcttccatttgagattcaattctttgttgttgacgttctaacagagactggatccacagccagatagtcatcatgccatcatgcccctcactgaatacatgcctgctcttcagggcattaaattagcttgatacaatggtatttaaaaaaaaaaaaaaaaaaaagcccagaagactcagccttgaaggagttttgccatctgtaatcctgctgtttgaggcaattccaggtggcaggatgcgagcgaggcaaatcttatgacatttagacaaagctggcagtgagcatggcacgcaggagggcactcaacatcacagctgttctttactttatgcctttacatagaggtatgttcctaaaaagatatttgagaagtgattcgggcagagtaaatcaaatcatggtttacatgttcacgggagattgccatatatgaggattgaggagaatccttctgcaattatctcttaatttactcattctacaatgccagattttccttcatgctggcttttcctactgtggctgaccaaagtcatcctaaaaagcattgaagaaaccttattctttagaggggagtaattttatactatttagccttcttgcttttcttctttttcttttttgttttctatcttttgttcagtttggcttctttagaatccccacagcagggggtggggaagacaaaatgacaaaaggtagaactgtaagtcatgaacccagttcaagatggcagctcttctaaggggatttgttttccagggaagttgacattgttgcttgacttccctgcccagatcccttccctccagatcttcatgggacttgatccttcacgtcatttgagtctcgacttaaataatccttcctctaccagaacttctcagcccctagaggctgcctgatccttaattgcctatacgcttttacttttcaccttaccactttctgacattttattatatactcgttttgtcacttgttaattatctagtcctattcagaaagtgaatttcatgagtgtagattcttgttctgttttgttgattgcttcatccccagtgctggtaacagtgcctgacacacagaaggtgctcaaaaaaaaaaaaaaaaaaaatacttattgaatgactgattgaatagtttggacaaattatgcacttggactatttttttccctgatctatttttttttttttacccctgaactaaaaacacaaaagttgaccatagtccatttatttcctctgattttactataataaaagcctgctagaagctacctataccatttaaaaagttagtattactgttcaaggcacatacatgcacagacatgattacctgccccagtggtggacaccagtttgggcttgctgcgagcaccatctcctttggttgtgtaggctgtgacggtgagggagtaggaagtttcaggctggagcccagaaatgatcatgtcctgaaatgacaaaatagaatgtcactgattcaaaacatgctactaatgctctgggggaaaaacaaggccgtctgccttcattctgcaaatgctcgcacatcccttgcagccatgctaagccctggaaatttcatgcctgagctcatgctatggagatctgttttcatgctgatatcgaaggggcatcttcaggcatcttgggaggtagatcttagggtattagtcaaagacatgaaatctggagccagacttcctgaattcttaaacttaaacttgcatgtccttactagcttggacagaccaagtatgtttacctatctgtgcctccatttcccatctgaatgttggaattataataggaccccataggattatatgagttatatcaggtaaactcacagaactatgcctggcttataggaagcattccattaaagagtgattattttatgccaacagctctccacacatatccactgtaacccacagactacagatggggctgatgccagcatagtctgttttatcactatagacgaattttgccaaatggttgttgttggacctagataccctgagagagaattttcttaggactctcttattaatggattgtattatcatttttattggttatttgtataggctatgagcagaaatcattatccactgaggagaattttcacacacattaaaaagcagccataaaagcaaagaatacaacaggactttagttttaccacatcactagtatgtgctcaatttattttgactttctaaaaattgttaaatatcacatactatttacctaaattcttagttttctcttagtcagggcccaaagctgtggtggttataagaccagatgctctttgatatattcctttaaactgcaggttatgggattctttagagattctggctattagcttattctagtattttaagaacaaataccagagctgcatgtacacatgcgcgcgtacacagacacatgcgcacacacacagacacacacagacacacagacacacacacacacacacacacacacacacacagcaatataaaaaccctttcagatttttggcacagctgtgttttcaaattgaatatggataaatttaggaaaatgcacaatgtcattgtcttccaaatctaaagacaatgtgagtgacgagtacgaattatattgtgtgaaatacagtaggtttttttttagcaaggctgtaacagataccgtagagctcaattgttgaagctgatcccaaatatgacagtttctgggaacatgctttctcaaaagagtaggaatatctcactgtggaaattcaagaagttcagatatcatcctgaagagtcactggaaattttattctgccagataaatggactatttgggagaaatgttgtatttccaggaccttggaatggtttccctaacattccagaggatagaaaaaccaagtaaactacccaagagcagtattttaaatgacagcagacacactggctatcccaaaaactatcatgagtaaatgccaacattatggtttccaaggttcccctcacatgccactggagtactgctgaaaagcagtcatggctaactggaaaaagcagcaaggcttgcttccatcaccaaattttgtagcaagaaattatgcactctgagacttatatgtttcttatcatgaaattggagttaaccacacatatccattatcttgcccaggttgttagaggataacagacataacgcaatttgaaatgcgtcaagttccctgcagtggtataatctcggctggacacacctccaactgccacggtcatatcctttcttggattacattttctttctttaagtggtgggtgcacttccttccttggttgtttcagtatgctctgtgaggtgatgtgcctgatattatggccataattcctcattctctttgtttcctcctgtcctgtctccactttgcttcttgtccctgactgttaaaagttggcatacctgaggttctgtcacagtcactggtctactgtttctctaatcttaaaaaagaaactgcattcatttctaaaccttaaataattatttctgcccatattcctgatttatttccagctgtgacttccaatctgagctccagtggcatatacattgtaaatatctgctagatgttttcctgtgactacccagtgttacttcaagttcaaatgaactaaaacttaaaaatcattcctggaagtagactccccctccttacttccatattttaatgaacggtaacacatctgcaaaacttatgagctatctttgacctctttctcttcctcagttcttagcaagtttttgccaattcttccttttattgatcctaactatcactttttcatttctactgcctcaactctgttgcatttttatcacttcatgactaaattagcaaaataactctttttacctgctttcctatctgccacctttttactctctaatctatccactaagtcactggattttaaactgcaggtaatgacccatttagtaggttgtgaaatcaatttagtcagtcatgaccagaatttaaacaaagaaacaaacaaacagaaaatgaagtggaataaacttgaatacttaatgttagtgtttattatacatttaaagcatggttctataaaaattttattttagttaaacagaggtgtgcattgaatcatgacatacaataatgtatttcttactgtgagttatagtcaaagaagtttacggtcaaaaatgctgctgcactggcaatcccatgagaactgataccttgcacacagttacaagattcccaacaagagccatgtgcattggcagtaaatattcattcagtgaatggaagaataccgtcttgccagcctttaactcatttttctttttatttcttctatatcactctaatattgaagagttaaagactgaccggccagctttttagcttgactcttctggttttcccagtattatattatagtttacctcttagctctatttaccactgagttacttaacacgaagccttcatttatatcaaattgtcaggctcactgtcacgtgactataccacatgctcaactgtctcaatgactggttttgctgtgatcaactttaaaaaatatgtatgttccacctccaactctccaacacacacacacacacacacacacacacacacacacacaaacacacacacacacacacactttttcacttattcagtctttagtcatcccttaaattctcaactaagcttcaggacttcttttactatcttggaccactgtctctgaattcatagcttttattgacactgtccactaatttactaatgcatggtccactgctgtaggccatatattttgctgcgttctatgaaacttttcagaactttactcttccctagccacttagaatgtaaacactagaaaggcaggtgtcacatcatgtgtcccttgcagtggcatatacataacagtccctcaataaataacatagagttttcattcaaatattttaaaaacattcctccctcagcgacatactttctacttcttggcataatccattcaccattcaaatatgtatgggtaaagtgaagaacagccacttctagttagagttaatcagtgccagatctatatcttgttatctactggatatgcgatcctggagtcagatttatgagcattatgagcagcctacaccaaacaatctgacatctccagtctgcaatgccttcatttaaagcaggcttatccaacatgcagcccaacacaaacttgtaaactttcttaaaacattatgagatttttttctgttttagctcatcagctgtagttaatgttagtgtattttatgtgtggtccaagaccattcttcttccaatgtggcccagagaagccaaaagattagacaacacccctgtgttttaaagcatgcctcctctgactgtcacaaggcagagttagtagcagccatcaaaacaaatatcacaagcccatgacatttcttacgcagtcaatagcaccatgctgatttcacaaaacaaaaaccaaaataaaaagtgcaccacacagtgaagataacttaaaaataatttgttagttcatgcatccaagcaaactgtgatgacagatcacaaataagtgaaaggatgtcagagaaaacaagcatatatagtctgcttttgacaaaacagtcaaaaattactcacatgttcagtagtatcatcaaattcccactgattgagaataagaaggttgggaggaaaacaaaataaaaagaaaaagaatttaaagccttatacaggcagtgttgcccttgttagattaaaaaaatcaaaaaaataaagcagtgtgtacaataaaattccaaagaatgtgtgatttgctgccacctccacctctgattgggaagtcaaattaaatatcctttgttactgttatcactaaaaccagctaacattctttaaatgtatggttcactgaaacatagcaatgaggcacagaaaaagttaatgtttctaatcatatcctactcgtatttattttgacttctatcttaagttacacaattaaaagtcactatttagattaatatctttcattatatttgacacttataacttcaatgaagtcctgtgagatgtaatgaaatttcagtgaagagtcaaggaaagtaaatgagatgggaaagaaagaaaatacacaaggaaaaacagcaattaataaagaaaagccaaagaagaagagaaaaaaagacagagttcacatttaatgcatttggtattatataatttcgttaactaccatattttgcaatggaactagggagagaattacagttctgtaatgtaaaatatctaagaaccaaaggagaacaccaaagcacactggtcatattgttttcttttccataattgtagacttacaagataaaacgtagcaatgatggctttaattttatactacgataactttctttttataggcactacataataattatttatacaaatcaagtcaatggcccctttccagtgttgaaggggtattacgaagcactactgcatttacagaagtggcctcggggtagataagtgagcaatgaatccagatccctttacttagaatgtttcaaaactgaagaaaacataaagacttctgagagttgacttgtattaagactttgggggtaagtactttccttagaggcacagggatatttattgctgtcttatttttttatttttttaattttattttttgagatgcaatcttcctctgttgccaggctggagtgcagtggtgcgatcttggctcactgcaaactccacctcctgggttcaagtaattctcctgcctcagcctccctagtagctgggaccacacaggcgtgtgccgccacgcctggctaatttttgtatttttagtagagatggggtttcaccatgttgagcaggatggtctcgatctcttgaccaggggatccgtccgcctttacagacgagaacgtagaactgggcaacctggtgccgcagttttcaacttgcttcataacctttccaactttcacacaaagaaacgcattttcatttgaaataaatttcaaatgtttttacaaactccatccttttccctgccaagtcaccaatttcttggataatgaaagtattccaatgatcataatatcctatccccatgacatctcatcaccatttgacacagcaaaggtaagccagtacatgagtcatgtacaattttcagcatggtggttacaagatgaaatcttcatcttcctttcaggaaaatatgtaaaactcaagcgaatttattatgggactatctttgaatcacctctaatttatgaaaaattttggaaattttcaatgctctgttttaaacaactaattataaaaccgggttgtgataccatagttgcaaaccactgccctaagatcaatacaatttctcacatactcaactactcatttttagtaccttttttttaaaccttggttcaacgtaaggatcccacttatttgctaggaaattctgatttaatttttaatatcattgtaacgatcttcatttgctgggacatgaaacaatgagtttcatcaaatatgtaatttgatgaagaagtactaaatataatactgagtacctgtccctgaataaaaatgtctattcttcagtggaagaagacacacatttagaaattagaacaactaagttgcaagttgttttagcacagaagaaagtagactccatcagcaaaattgcagtttagaaatcttccctttgactcaactaagtcaatcattttttgaagtcagaaaggcaaactcaaatatggttgtaaagggttgaatatctgtattttaaggaaaaagtaacatgtttttaatcagacttgagtgtcatttcattacaattcccttcctcacttgatagtaactctgattgaaaagatcaatatacatcaatgtgaaatgaaaactagaattttgtataggattttttaaatgtcgaaaaactaaaataagagcaatttcaggatatgaactaagataaacttattatataaaaacagaggtacataatttcagaggcttacctgtgcatcagccagcatgacatctttcagcatgggctggcccttgggctcaccattttccatcctcacataatgcacctgatatcctcttatctggccatgctgtttattgggcacgggtgagcgccatgagactttaacagatgttgagttgacagcctctacctcgactttgcgaggaggaccactaggaactggaacaacatcattggataaaagaaattataggcacttgtcccaccctatcagagcattttctgcattttctttacttaggtttctctttcaaaaaatgggtaaacccactatgttttctttgaagaatacaaacattttcaaccaatgaaaatgcttaaccaatctgctctaccttttaagaaaagatcaaaaaacatgaccgatgcaaaaaaaaaaaaaaaaaatggaagaaaaaaagagtatcagagaaatagaaaaacatgtaaaaaatgtacaaaagccaaggaagatgctttgaggttcaaagcattaaagcacaaagaggtatagcattgaaataataacaaaaactggctgttgattgttgtgtgttttttaaaggtttctttttaaacggcagaataaaaagattcttgattatatgtattatcttctctttttttctcatatcaaagttattccatacaaaagatgccaaaaattcaatgttgagcatcaatgtctctgaaatatgtaagacaaaaaggcaacaaaaaggtaagaaggtagttttgaaaagttaacttcaaaatgtaaaagaagtgactacaaaaagccaagaaaaacacagaagactttagatggaggcacagagacgggctggactgcaagaccataggagccaacagttcttttaaagagaagcaaattactgcattgagattgaaaaaaatgaaaaaaaaaaaaaaaaaaaaaaaaaaaaaaaaggccaggctgtagcaaagacaagtctttggcaaaaatactaaagtaacagcaatgctgggtaaaaagatgagcagagaaaaaagattactgtgagcctattgaaagacagcagatcaagactgtgtcagaagggtgcaaactgacgtagcggaggcaacataccatcttcattggttcgaatcaacacggacaagctctcagggccagggccgacatctgtatgggctgtcacagtgatccggtattcagtccatttttccagctgttccaaaaggtatttggtagtgtccgaaggaattcccaaaatctcgtgaggcttgtcatcttccccatccactgcagtgtacttgatggagtattcagtgataatgccattctgtttttccactggtgg

SEQ ID NO: 81 - DNA, 165589 bp, Homo sapiens
gaattcccaaaatctcgtgaggcttgtcatcttccccatccactgcagtgtacttgatggagtattcagtgataatgccattctgtttttccactggtggaggttgccaacttaccaaaatactagtggaacttgggctggtgcaactaatgtcttgaggaggagctgacggctcttattttggtagtgagttaaaggaggatttaagtgaaaggacaggagtggttgaaaaaaaaaatgataaaacaaaagaaaaggcaaaaataaataaacgaacaataaggacaaaatgaaaataaggctttgaaacttaaattctaatgacaaattatgtaccttggcttagtaatatgaataaaccaaaaagagaattaatgaccaaaaataattgttaaataatgggtagggggaatatgtgaaaatgagacctcgagataatggagcctcaaataaaattacctacctgcgataaaaattcttctaaaccaatccctcagtatctcccacccccactatactgactacccagcttcaaaaaagctgcaaatagtgctagtatttacttgagggtctgatgatgcctcacagatgtttccaagctttcacttctatattctagaatgaggatggtttacatacagtactcatttgtgaaaggcttcttaagtgtgaaaagttgcaataactgctaatgcccttctaccagttccaattaaaaataaataaacaacaaacataagagggttcactctatctgaaaaactgagtttgcctgaccagttttaataataaaaaaaatgttaacattgatcatagcccatatacagtgagcatgcagaatcaataaaggatgaaaatgcagagtccaagatttacctacccgagggtaatgtcaggattgttgattctgactgtaacttgtacttaccctacgtcagctttcagctttttaattataactcttcttgagacaccattgctagtgaagaattagaccccaccagcaaaatttggtaaaatcaataataatcatttatcccttacaaaatgtcaataacacagccattaaaaagaactgtttttttaaaaacccaagtatcaactggaaaagatataatttctgtgcaaaatttctttcattttgtacataattattcatacaatgtagggtttatattagaattagaagacatactttcttactgcccattctaaattaaactagtcactttctgagcaatcattttccatcaaattaaccaagcattatgattttaaaaaattaaaaatcaataaaagacagcacaattactatcattatttaaaacttaataatattatgttcctaaagaaaaacaaacaagtgggcaaagataacacaagtccatacacacacgcatatatttttaaagcaatgtatatggtagactgaataaagcaatcctatatttcatatttgaatgtgtagtctggggatttccctagactttgtgactcttaacattacggagtgccaggtgtatccaattgttcaggggattatcagtctttcttaatgtacgtgccttgtgttcattattacagtccatcaaaataaaagctctctgtactgacaaaaaagaaatcctcataggacagccttgtaaatttggaataagatttgcaaaaccactagaatctcatttttattgattctgactaggggttcttatatctcaaattataaaactattttacatgcattatcattattcataataaattgagttgttcatgtaacagcaaggactcatctgtaattctttttaaaaagctgatttggttttcactagggctatcttcagacctcctattttgtgagaatatattcaacaccatttgaaaattttactttaataaaataaggaatagataagtgtttgatgtgcttataaaaagtctattcaatatgtatgtgtgtgtgtatatatatatatatacacacacacacatatgttaaaaactgaggtttgtaaaccatgggaaatataatattgaagcatgtaacatttctcttaattaaaggcttggtttttagaaattatcttctacaatactatttattagcctgcctggaattcaaagcagacatacagagaacgcattaatttacatgcttacgcctttaaatgaaagaaaattttatgggaataaacgataatcactaatagattaaacatgatcctaatcattttcatgtgaataatcatgctttaaagagggaaaaacataaattttattatcaaaaaaccctgaaagttttcaagtttctatagaaaatgaaatggtggaaaacttgcttatttgtatggaaggaaatgaatcttttaaatcacaaatttcatgtttgctgataggtctaaatatgaggttaacagagcatcttcttgacaaaattcaatgtatttctactacagatatctattgtataattcactatgtcaaaaagtaaagacaaaatatcacacaaagaaatctaagaaaataactcaacaaaactcttcaattcaaggtaaatagtattttttatgaatgaactgtaaacacatactaataaaaagcaattaataataataagccaccaaactttccaccaaaaacaaaatcctgtataatactttatgcaaaacaatctgccctgggaacaattaacccccattgtgataaacacagctatgcttaagggtaacagctccaaaaagaaattgaaccccaggaaacaaaatacaatttagaattgcaaatatgtttgcgattattccattgtttcttaatttgtccacatacagattttctgtcaatgttccaaatttccacaggtactacacacagagttaataagaaacaagtcatcagagctgagcttttcttagtagaaacaaatacatgaaataaggacttgtttgattgcaaagctaaagcctgtgtgcttaaaaaaataaagtttttttttgtcttttgcagcctctttcatttgcgaagccctcctatgattattttacagggttctcaatgtgaattttgctttaaagacttgtaattcattaaacagggcttgatctaactcctttaacccacatttcacccatggacgtctactaccttctttaaaagtctttcagtgtaggaagtgggaaggtgggatctgttatttggatcaagtgatgagaccaaaagaagtcacagttacactttcacctgtgaagtgtgatgcatactaacctagagactaactattaagcatattagcaggtttgcttattggtgaaggtgaaagctagcaacatctccccgaggaaataaaaaggcagaaagtaagcaaagagagacacctacttgactgcatggttctagctgatatttctgcagtagaagcacccaggccttgaggggagcgtgcagccagacggaaatagtataagctgtttggtttcagtccttgcagcctatatgatgtccctggctcaatggtaattcgttgctggaagcaataagagaatgtggtcatcttcattaaggttcatgcaaatactttttaatcatactgtctggaccatcagatttctatcatcaggattataatctcatcaaaatatcaccaaaagagtcaatagtgagtatccagggctatactaaggaaattatataatgaaaatatcagtttaaaaggcaagtttctacaaaggtaactggaataagggaagtcagagatctttttaatgttgacacagtcagccaaatacatcagataagacgaagattgagaggccaacacccatgagtatgttctgccgttaaatgtgtgtatgttgctgtgacacagatcacaatagaaaatgacacctgcccctggtagtggaatctgcccaacatgtgcaattttaattgaacagatgtctactcatctcccatgaccttctgaaatctcaattggaggcaaagaaaacatgaccagaagtagcaacagtaaccagtatacaatttacaggaggttgctataaaagagatttgaaattgccaagttttaatgggtaaaatatcacgttagtcactaaagaaagttgaataatttatctgaaaccacattactaccctaggttgatctaaaataactgaaaaccttactttctttgtgaataaagaacccacagccagaaaaaaaatagattcacaaatgtttgtggacttttgatatacgatttcgttaatcaaatgctataactctcaccttccgtgcttaaaatttgtcatttagcaaaaatataagtgtctatgggtaatcaatcttgaacatcagcctgcagtaaaccttaaaatgcaagtgaatacataatctagtaatggtgtgtgtaatcttaacactttatcaaatagtgtttgctattcacacaaacaaatcagttaagaagaattcaaggccgggcacggtggctcacgcctgtaatcccaccactttgggaggccaaggcgggcggaacatgaggtcaggagatcgagaccatcctggctaacatggtgaaatcccatctctcctaaaaatacaaaaaattagccgggtgtggtggtgggcgcctgtggtcccagctacttgggaggctgaggcaggaggatggcgtgaacccaggaggcagagcttgcagtgagcagagatcgcgccactgcactccagtctaggcgacagagtgaggagactctgtctcaaaaaaaaaaaaaaaaaaaaagaagaagaagaagaagaaaaattcaaatataaaactagagaaaccatccctagggtgttctgacttacaaatacaaaagttttcaggaattttagatccaccaagtaagaaataaagaaattccctaaataagcaattgtggagcacagtagctatgccaacatttaagcatcacaattctcctttactctttgtatatatgtatgtttgtgtctatgtatgcctgtattttagtttggtggtcgtgatgaaggtttaaacaattcagtgctgatttacaccttacagaaaacaccaatagctcaagttgtaccatgaaaactttaagtcatatctgcatttcaactatataactttttgagtgcttgatttatattggctttgttagctaaatctaaaaccactgcatttaaaacctattcttttgagattctgctcaattcaaacagatggaataaaacagaagtttacaagaacatattaatttattataacatccaaaattatgtactacaagttaattgagagtagttcatttagcatgtgagttttttaaaagatattctttattagaacacagggactgtttcactttgtgaagatttttttttcagataaaaaatgctaagaggcataataaaatgaatatatgtgtgaagttctcaaacacagtgccattaactccttttgtcctaatgttccccattggatttaacaataataaaagaaacatacttactactattatgtattctcattctgaaaatgttagatgtatcttaatatcgatttctatcatgtattcaaactgcactcaagaagcagtagaccctaaccgttaacaacacagactctggaactcgactgcctagactcaaatcccagctctgccatccactagtgcgagactttgagcaaattatttaactttttttccatgcctccattttattatacgtcaaatcgattaataagaaaggctagctccagtgctactataaaaattacatgcattattgatggtgaaacccttagaacagtgcccattaatgagttaattatattgattttcatttctcttttcagtgacgatcaacaattgccatgccttctacaatctgttatttcatttgcacagcatactcaaatgttatacacactcaccttcataccaaatactttttagcaaacaaacatttgctattggggaatctttgaaaccagggtggaaaaattcatctagccaaggactttcattaacatatagagctaatttagtcacctgtccccacagtgacttaaatactttcatgaagaagagaaagtcctcaagtctcattgagtatttattcttccataacctgatacatctatggaacttggaactctgtcagaagcacattccaacaggaacaagagttattttgttttgtttttccccaaagcctccaaataaccactgttttttgtcattgttgttgttttggggtttttcttgggggggagggggagtcaagttcctcttttaattagtaaatcttttccatcaaggtcctcaatagctctctgaccaagaatgtggataaatacacaaaaataaaaaagtggccccacgtaatgaataattcccaaggtgagaagcactatagtcttacctcctctccatgctccccatctttgtagaccagttcatagttggcaatggtatctgaacgtggaggtgtccaagagagcaaaatacttgtttcagactcaggttctgctttgaagtttagtggctgccctggtactaaaaacagggaggcaatggattgaactcacaatcaccaggagtattcacaaagttcttccattagcgtaacctgcttaaacctttcgaaatctgtacacatgtaccagcttagtggaaaacaagctcctttaccttgtccaagttaacctctttgtgtacagggcaagtacaatgttataaatcctgctctggagtagtagaacatctacacaagatatagtagaactaataagtataaagtatatcggcctctgaattcaattttaaggaaaaaattctttacttcatgatatggttgttagtaataaataatataatttacataaagcacttgaaatattgccaaaagcataataagtacaaaatacctaaaagtattgttatttacaactgagtaggaacttactctctagcactacatgtaacattcaaaattatttccaattaaatttatgaaatcctacctttacgccaataacaaaacctaacaggcaaacagaatcactcagcattttttcttaccagcccacattttgaagaagaggtgtaagaaaggaaaaacaaaacaaaacaaaactctatcacttacaaataatgacttctaatctctaaactatgttaaattatttaaagaactacacctaatacaaacaaaatatcctctctagtgccacaaagctaaactactacaaaaattaagaagtttataggatacacttatcagaaatatggtaacttaaagagatcatctataattctcatgttagccatgtcatctattcaacagacaatttggaagagctgtttatcagctgtaacaaagaatggaaagtctattcagtttaaaacaccttactcaaatgaactagaataattagtaacctaaactttctagtccacacctaagcctatcagttcccctctatccattatacacaaggctgagtcagggtgtcgctggcacatctaatcgtacattgttcttggccactgtctgctctgattggtgagtgcctatgctttcccaattgtaaaacattttgatcattacccttgatattatggcatgtctcaatgtgctgtggctgaacatatgttcatattccctcaagtttaaataagaattccatttatatttaaagaaaaaaagagaacaataatacttcatagcagaggagtaaaaaaacatctaaagtgtgctttaaaacatctaaagtggcaacctcagcaaaaatatttaaaaatacatataatacagtataatttgtagttcaaaagaagcctttggagaaaatgtattgctttccttttcttttatagttatgtctgtgtactatggctttaaaaaatgccctttgttaaagcagtctgcaagaatgatttgtagaattcctaatgataattttattcctctggtaagtcagcctgtgtatatatatgtgtgtgtgtgtgtctgtgtgtgtgtgtgtgtgtgtgtgtgtgtgtgtgtaaaggaatatatgtttggactgatgcttaaggtcacaaataatcagtgcttcatatttctagttgccttcatcatcttttctctctctctttttaaaaatcacaggccttgagagtctcattgatttgatgcctctgggagcttaccttctgaacagagtatcacatttttttccccagtacctgcccagtgggtgacctaacacaatcatttagattgaaaggtggaagcgaaagaagataaaagattgagaagcaagaggcagagggacagaggggaacaaaacacaaataggcaaactgcaaagcaaatggaaaatgcattatttctaaaagggaaataccaaaagcactggcaggagcaataatggaaacaagagtgaccagatagatgggaaaattatgataggacctaacctaatattcacatgataaaagggtttctcaggctaaaaatgcacacatatgcctatgtatgcagtcactgatttttttcctagttttatttgcttctttctttctcccaatttcctgggaaacaagaaagtttgtgttaactcctgactcaaaccaaaccggactacagtatggtcaagaattagaaacacagacaacactgaagggctgctctcgggataataattgcttgttacgcatttcttccctgcctaatgctaataataaattgacattgattgaaaacatcttggaaacctaattaactttttcttacttaaactgtttactttttgcttttaatttgtcttgagtaaattcccggttggtctcaatatttcattcttgtttagtgacacaagctttgtctgatcatctaattctgcttgtttctattaagagccccttccttctaaataatgacttaagtaggcacatccaagtctcagagagtacactgtcctttttattcttgcacaaagctaaaggttggctagacgacttgatgcaaagtgtcttcatctaatgtacagggggttctctcctgttctttccttatccttcttttgaaatggttcggaggttaacttcatttattagattttaaacttgtggttcaggcttaggcatggtaactcacatctgtaaccccagcactttgggaggccaagttgggaggatggcttgaagtcaggggttcgagaccagcccaggcaacatagcaaaaccctgtctctacaaaataataaaacttaaaaaaatcagctgggcatggtggagcatgcctgtagtcccagctgcttgggaggctgaggtgagaggatcacttgagtccaggagcgtgaggctacagtgaacgatgactgagccactgcacaccaccctggatgacagagtgagaccctgtctctaaaaataaataaataaataataatatataaaataaacatgtggtgcgaatacaaatgctcagaggtgtcaggtaatttagatgagtgagaaggccatatggggcctggggcccggtggagagtgcccaccacctgaagagggaccgcaggccatgctcagtgacagcaggttgctgccttgtgaaatgtgggcgcactcttgtcccagcttccgatttccttcacagaagttgatcatgaaccttccaggtaaaacctttccattcttaattactaaaaattaattgaattttaaaagcactgtatggggcaaaatgtgtctacaggctagattcagcatatgggccatgaaataaactttcatgatctcaggctccaggctcatcaatggcttaagagtgcactacccacacttcctcgggaactgagggtgtacctaacgatatcacttcctcagggcattttgtcatatttgaatccacaaccatgaagctgaggacacaaaggaatttttttaaataaggtataaaatgaatgtatttttaaattcccaacatattggtcctaatgagcataatatatgtatataagaaaacactttgttttctctggaacacttgagacatgggactactttcattatctgtctattgaatttttataccaaatattgggtctacagaggttccatttcacatttctattaatgttttctctctatatatgtatttatacatataaatgtataaacgtaaatatttacctacattttatttatatatttatttagttttgagacaaggtcttactctatcacccaggctggagtgcaatggcacaatcatggttcactacagctttgacctccaggtctcaagtgctccttccacctcagccccctgagtagctgagagtacaggtgtgtgccataacacccggctaattttttaatgttttttgtacagacagggtctcaatatgttgcaccaggttgtctgaacttcctgggctcaagaaatccttccacctcgaccactcaaagcactgagagtatgggtgtgagccactgtgcctcgccttcttacacacagatattttatgctcttgtaatcactacacatcacggtttctcactggtatttttttttttaaccttcacttaccagtcctttgtctatgtatatcttattttatttttattttattcaagagtttttctgtgttgtaacatttccttcactgattaactgaacataaattttataagaaaatgtgagattctgggaaaatcatgggcaaataaaaacaacatatccagacctttaagcagttacttcatattcaaaggagagatatgatattgaccataaaccagatttacaataggacatggaaagcaaaaataaaagaagcaaaaatttttctttaatattatatttaagaagtcattatatactgtaaaagtatgtccgccctcttgattacttacttaatgtccacaaggaaatagaaatgtgagctatcgagtccctaaaatgagatcataatcctactgatacatgttaagtacttgagtattactataattacactctatataaatatgtgaaagcaactccaagacaagggatgaaaaagactaacaagagaaaccttcacattatcagatgctgatatattagaagagattaatatttgaataaaatgtagagattatctctaaagaaaggttgacacatattgcactgctaaacaacagtttcatcttgctatagtataaatatgaaatatgaccaaagatactagaaaacccatgattgctaaaatatccagtattttattaaggtacatgttttaaaatgtgtgtatctagcatattgataaatgataatgacaataaaaccgacagccagaattataacggtagtaaaacaaagcaaaattcaaaacaaagagtctgatgtgtaaatgccacaaatatatcattgacaaaataagtacttaatacacaagcatcagcacaaatcttattctcaacagtcattaaatataaatgagaaaaagttaaattttattatagttgtatttatatccagtgctcctttactcattgctaaatctattcagaaaaagcatttaaattggactcataactttggttattagaaagcagtctttttctagtttgcttgtataggcctgttgacatacactaatgaaatgatttataaacttctggaaacctaacagactttgtctctcaatgtcatagcttatattttaacacttttgcaatgcccagaatttgtaatagcattaacatccctaaaatgtttaaagttgatactagtcattagtatttgataaatatatataattctttatcttttgaaggcatatactgttaaaggtatatccatataagtcagatgattttcaagaatctattaaatgaatagatgtaattagaggtcagacatgctttctaaatacagttcagaaaaaagacacatattaggatttaagatttataatgcctctaattagcatgaacatcaagcaacatttaatgcattaggtttgagatttaacttactacttctttgtcagagttttatttctacttcttctataaaatatagttaccctatgcttttggtacaattacctttacaagaaaactataggaggtccttttttccttcctgaatgtgttttctaataatgaaaatatttttctagcttaatataaatactttccttgtcaatggccatatattccccatattttcaaggtaaactagttgcaagtgactttgtaatgccagaagttagagctatggagaactgagaagattgacccatatttcagaaaataatcatctcaatgaaagtcttttcatatttaaaaccatttaaagattactcaacacggtcaactgtactaatgttcacaatcaaggagaaaaactctctgactgtaaaacagacagatcatattctcattttctgtattaccagaaatacacaaatttacatcaatccttcacttatgtccatctgtgtgactcatattagatcaaatcaaaagtgagacttctctcttaaactcactttgatcctaaatactgttcttttggaatccggtttcaaacaaaaacaggaatgtgaatgtcacagaatgaaagataataaaattaaatgagtaccttttagacacagaagacatcaaaatgtacatttctgtgtatttgtatttaaaatgtacttcaattcctacatattattgatcagtaaatttttatagggttagaggagaaaaattgcagtgaaaataatcatatccttaaattttatatctcataatggttatcgtcctagcaatcatcctaagaattctttagtcagtaactttcttgttactcctttttcttaaggagcagctcggcattaattacatcagaacaaacatcattgtttttggtaggtgtccactaatatccactggcctttttaattaagcctatagaacagatcaaatcattgtgctattttggaaggttttcttagcttattgagcttggcaggcagtcattacatcactatatatcttctcaatcaacatgtattaaaagtaaaactattatggaagattcttggaaacatcttcatgcaaaaaagtcagttaaacagagtgggaataactattctaatatatccatgtcccattcatctagattttctgagttctgtcattaaattaaatcagagcttttgaaagtagagtccccagctcacagtaactcagttgcccctctgataatgctaccttcactgagttatgattcaatgtcatattctgtccactggtcatataaaaaaataaagatatggtctgtctacttcaacattacttctatatttttcaatagattacgactgaaggcatcagggtttttcatttagcattctaaatacaaggattctcacaattgtctaagattcacattttggttggattaggtttaggaaaaattttgtttctcagataatcttcctaccatcagaaaataaaaatatgaaacactatagatttctatgtttaaactggtgcttataaaacttagagccaaatttatttaaatttagttaaatttcagccagatttactgcttgagtgtaacgatctttcataaaaatgttcttccttccacttcttttagataaacttagtttttttttttttttccatttctaaatgttttcatgtacttctgcactggaataatctaatagctacctcagtgtttcagaagtaagttatgtataattcttagataaatatatgaataaatgaaacaattgcgtttttctctcttgcctcttttcattattgaatacctacactggcataaaaacacaaaaactatcacattaagcaaattattaatttaaaaggtaatggtagttgataatgattaggctctgcgtccccacccaaatctcttctcaaactgtaatccccatgtgtcaaagaagggacctggtgggaggtgattgaacaatgggggtggtttctcctatgccgttgtcgtgatagtgagtgaattctcacgagatctaatggttttataaggggctcttccccctttgctcttctctctcctgccaccatgtggagaaggtccttgcttccccttcaccttctgccatgactctaagtttcctgaactctccctagccatgtgaaattgtgagtcgattaaacctctttcctttgtaaattactcagtcatgggtatctctttatagcagtgtgaaaatggactaacacagcagttaaaagtatccagaatccctggatttaaattctgcttttgcacttagtaaccttacgacctacggcaagtttctgaatcacgttttatcctctttgatcttcaatttactcattggcaagtgggataattccacatctgcctaattggtttgtgagaataaatacatgcaaagttcatagtatagtgtcctccatatgttagctactattatgatgattacatattaataatttaatgttttacatattaagttacaaaatgtttccctccattatctaatctataccctgttatgaattttattgcatcccacaaaaatccatatgttgacatcctcatccccagtacctcagagcataaccttatttcaatataggatctttgcaatggaattagttaagatgaggccataagagtgaccccaagtccgttatgactgtgtactagtgaaaagggaaatttgggcataggcatgcttttgggaagaacataatgtaaagatgaaggtagtgatcagatgatgcttctacatgtcatggtacagcaaagattgccagcaaaccaaccaacagaagttagggcagcagcattaagtatatttccctcacagccttcaaaaggaaccaatcctgccaacaccttgatctcagactccctaggccccagaactgtgagacaatagattcccgttgtttaagccacctagtatgtggttcttttttacaggagcactagaaaacaaatagaaccactacactctataaggtggttattattatagactagaaaactgaagttcagagagagatgacataaatcacctaaggtgacagctaataaacgaaagcttgggcttcaaaccctggttatgttactccaagaccagggattgaaaaaataatcacagctgagaaatttaaaaagctcaaagtggaatgtaagttcccatataatttcttagaattttttaattgttatgtagctgctaaaacagtataataaaaagcaatctcataatagttaaccacttttagtcaagaaaaagcaaaacaagatttacggatgtctacatttcccaatgagaagcttttttggtaagaacagcctacagtattttttttctgcatattactacagcaaataaatacagaagtactgcaaatggcacacagagaagatatatggatagtttttaatacaactgtggtgagacatatttttatagctggctttcctacaatgtcatagagaaaagagtaaatccatgaacaagccaataagaaccaaataatggtatgaaaataaaggcaggcgaactattaatataaatgtgctctgagattcctagaagcaaggacaaatagttaaacatacttcatataaagaccatgccatgaaaacaagtcagtgattcacaggtatcagtgaaatagatgataggtacattatctagtactggcatctgagaaaatttattaattcattgccaggattagcaatgagttatgtctacagattatactgtctccaataatatgattattatgtagatttcaaaacaagccaacagcatgatgccaaaacattcgtagattaatgcaggtttaaaagatgccaacacaataaggagtcaaagaagtagctctcagatgctcaagaataaactttttttttttttttttttttttttgagatggagtcttgctgtcacccaggctggagtgtagtggtacaatcttagctcactgcaaacttgcaaactccatctcccaggttcaagtgattctcctgcctcagcctcctgagtagcaggaattacaggtgcctgctaccatgcccagctaatttttgtatttttaatagagatgaggttttgccattggccaggctggtctcaaagtcctgaccctcaagtgatccacctacctcccaaaagtgttgggattacaggcgtgagccactgtgcgtggctcaagaataaactttagaagaggcctgttattttatattagcccaaagccaaactgatcaccttgactcaaagaccaaagaggtttgataacctcttagaaaaataaaaccactgggagggccaagttttccttcataaaatagtctaatgtctgctgtagctcttagcaaagttaatcaatcaggcccaatgttctatctgagatctcggtaactgtctctctttatccactgaggccatacagagaaaaacagaaattaaagccactcagagaatacttattttcaagccagtagcttctggcaaatataagccatttaaatacccaaggccctgtaacagttttattttttagctttgtcttgaaccatccaatcttacacaaattaaatactcttttgagaccactctaccatactagctattacaaagaagtgtcgtttttctattctcaaaactgggcatgggggagacattgttctatctcacatagagaagtcttcaagtcattcccatacaaattaaaaagaaggggtgttaatgcattgttctgctcaaaatgattagtttttcagatgtccatgcttgttccttttcagatatctatcatctgttgctttgaagccctaaatctcaaaaattaaaattcataccatctttgttccttctttgtttttgtccttctcacctctttgcaccagcccttccctcctgccctatttccctcctcaaccaaacttacctcctgtctgagtgatgacttgtatgtcacttgaaaggggaccatctccaattgaggtaaaagccaggactttgacagaatatgttttctggggcactaagttgccaatagtagtgatttggctgtcagctacattgtgtttcatccagttgttgacatgttgagtgggatccattgtataataaactctatatccttggatctgtccatttggctcttcaggttccttccactgtaccaaaatggtggtcgaactcaacattcgtgcctggacatccctcggggcactggatggtgcttgctctgaggtttgtgttagcacaggttcgctgggaggcccccgcccaatgttattgacagcaacaaccctgaattcataatccgagtagggacttagtccagcgacactgtagcgtgtggtcgccaccccatcaatttctttgtaaagttcctcagagtttttaggtttatgctgaattatgtaataagaaacaggctcagggttcccagagtcccacgtcagtgtgatgcttgtagctgtgctctcggtcactacaggagttcctggaggtttgggtaaggcttggatgggggaagataaaagacaatgactacccatcatccctataatatttcaaaaatctataaactctactatgaaaatgacaggattatgtatctactgaagatttaattaaatgaaattatagcaaagagtagttttctgaatggccaagaaggacaggaaaacattcataggtgacacaaatcctgctttcctagaagggcttgatagcatatttttaggcttgtatccaaatcctctacttattagctaagtgatcctgcacgcatttcttaacctctctttgctttagtttcctcatgtggaaatgggaaaaatattattatttaagtcatattatacagctgtatgtaactgtatttcatgggtttgctgtgaagactaatgagccaatccactaagattcttagaatgtaactggaacccacaaaaaaaccttagtattagctgcagttattactattattataccaaaagcttggccaattagccccttgccccaataaataaatggtataactgaaataccgataaacattgaaaagaacaaaatgtggaatacattgaaatgaaattaaattgcgatgaaacaataacatctatattctggtaagacacaataccattactaaaaattttcttgtaaatgaaaaaccaaaaattttaaggtgcaaaagaatagaaatttcaaatcaatgctttattcttaatatttaaaaattgctgaaggaagtaaattaaggcacattcaccaatcactttttaaggtatgttatggtcatattaatatgcattctatattccacatcagaaatatccaatgtagctacatgacaaatatttgcaataaaatccatctttttagaggtctaattctttctttttagcagaagaatacaaatcaaaatactactaattaaaaatataaactgtctgctttgctgacctcatattcaagtgccttattctaaacaatgattctgaaacgcagtgctattagggtaggaaggggcattctaatagttgactctttagagaaatctcaaagggtaacattcatataatcagcccattagtgtccctgtttccttgccaacataaaggcaagaagtataacaccccctagaatggcagcttttcaagagcagcaaacttgtacttctgacttactgtaaaattgtgaatgcctagaatgctgcctggcactcggtaggtttttaatgagaatcgttaaacagttaactgaataaatgagtcagcacccattcacctcattctcttcaacctgttcttttgttttgatttattttaatttgccattaagattcactcttatgttttatttgtttatttttgaggtggaaaagacagggaagtggcaagagtcaggaaaacaaagatgagaaggtgaacaaaatattagtttaaagtggcccctgcttttgaattcttaaaggtcttcagcaagccttcaaatatttaaagctgaaatggtaattataaaaaaggtgattcaatatttacacactactcaaagaactacagaatgatagtattttgtcaagggaatttactgaaaataataataaaatgaaatttgtttaaatattctgacctggcatttttcaaggctgtgtgtgctccagatttcccctacatgtctttctgaactttcaaagcaaatacaaatattgctaattaaagctgtgctcactgatatttagctgacattattagtttcactaagtcacatttattgtacagtacaggttttatgtctgtaatgtacggataaatacatgtgtgcttattatattaaggttacacaatataacattatttcacgattgtaaatgttgacaatgtgtacctttgttctcatgtcattagttttatatagcatatatttgatatatacgcttggttagagatgcgataccaattataacgtgtattgcattttctaagatcaccccctagaatggcagcttttcaagagtagcaaacttgtacttcttacttgctgctgaattccaaatgcctacaacattgcctaggaaaagaagataatttgtgttcattttgcaatagttctagccatctgcagaaaacttaagttgccctatgtctgactcaatttgcaaacactttctagaattctataaacactaggggaaaaaaaaacggtacccttacatgcttgtactctttctctttagttcaaaaatattcatgtaatatagtactttggttatatttagtctgttttttaaaggaaagaatattccttgagcactcatctatgcaaggtgaaagataaaactacaacagaatatactcttacttgccttttgatttttaatagtagggctcaccaaaaagttaaatcatctattactagactatgttgatttcaactttttttttcttctttttcctttgtatttagaaattttaagcatttattaatgctcatattgacttttcttggggttcttatcaaggttctggtctagtatgtagactgtacacatcagtcccaccataatggtcgaccatgtgtaaaattcctagttctgtctggttagtgcctgggcctccatggactgtcttttaatattctgatgattatctctacataggctgccagatacttccaagaaaaaatccgcctatctaggcttatgcatgttatataataccacagatatgattaggttatacacacatttaaaatgctgaataatgaattattttagattttcaaggatgggctttctagaggcattagtcacttggcttgagtgtacccagatcctcaaagcataatccattgagcatacctttgacagtgatctgtgctattgcttcaatgacacccagtgttgacatagcaacacaggtgtaatttgctgactgtcttacatcattcagttctagcacatttcttcctattggcatatcatcttcaggtgtcagatcttctgcccccaacatccactttacataaggcattggtgaccccacggccacacaggtgatattaacgcttccgcctggcatgatttcatgattagtgggtgggatagagaatcttggtgggacacggcgaactggaacaaaacacaagggaaatgataacatatacaaggcaagaaaaagtggattattaaacacatgacatgcaccgtacagacacgattcaacaattgaaacattgtggattgtccaaaaacaaaacataaagaaaaactgtggataatacagaccatacaagtatggtgtgtgtatacacagaattatttatttagtttagtcattgatatcttagacacactaatacaaaagttgattcagacctacaagggccccacaaaaaactatctacaaactaacaatacacaaacatcatgcataagataaacacaaaaacatatacatgcaggcatataacaatgattctatgcaggcatgtatatgcagaaaagggggctggaaggtcaccagcatgtttaagttgagtatcaaaaccaacttcagtgctgtgcacttccagttgatgtgaatgtaggtgtgggaccacactgtcacatcccagccctggaaaacatcacctagagtacactgaaagtgcactttatgttttcagattcatagtggatgcagcctcaagacctcacactaacactggaacaaacacagaaatgtatatacatattgatttacagtcacagaagaagaaacaggctaacaccagtagagatactggattgggtcatgcaaggcatgcacaagatggaatctcaaggcccgtgctaaggatattgaaagaatggctggaatccaagacagcaatgaccgcagaagaaataagggggcaatagaaataaacgtgaaagggggaggtaaagtataacgattgaaacacagggacttaggggatgacagggttgaaagacagaagattaagctcaagttgttaaaggtaaggattgcaaattcagaaagggagctgggtgtttcacatacaggattccattcaattcatatcaaaggtaaaacaacataaatgacaacaaaatcttttaaaaggctttttatgcccacattcaaattgagggacactggatctaaaacatacagcaggacatgacattaagagaagagatcatattaaagcaacataacacagaaaaattaccaagcaatttcagttcagtgttcctgcttcagataatctgcaggtttatgtgtgtttaagtaaatgtgttttggatgtgatacaaggagaaagtgaaagataaattggtttcatctggggcttttactggcaaaatgtcataccataagaatttgagatctagagggtaatctttagggagcacaccttaaatacatttaataaagattttttaaaaattataaataaactgataagtaacctcataaccccaagaagaagataagtaattctgtctgaaaactttttggctgctcttaaggtcgagataaacctccgcttatttgagatggctcactgcaatggcctcatgggtgaatgacagtcataggagaagaagagaaagctaagcatgcctcctgcagccaattcacagaggttacacaaagcaagcaggagccagtgtagactctgaggtatcaaagaacatatcaagaaaaatggaggagagtttagtcttcatgcttgggattaggggagaaactagaaaaagtcattctatgggcagcaggcatccttataagacagaaattaaaggcagggtgggagatggggacagtggagcaggaaggaaagcaggaacactgaccaagttcactggaccttacagagttaagtgttaccagttaccatgcacccaggtacattctctcccaccatgcaccacagttagataccaccagcaagcaccagaagccatggccagggcattctctgctaaaacataccattaaccaaaagaagaacacaatgcagctacattcatttcatttgtattctttgttattggtttaattaatagttttgtaaggtgggtaaaaagtaaaaaacacaccaaccttctcgcagctctgagggatgtagggggtttgatgcagaacacaatgaaatgaggaaaggagaaaaacaagggaaacacagagagagtaaaaaggccatatcaaggctttcaactgctacttgaacatctttattcgctctagttcatccttcctatctcagctggaaaagttagcaatatctcacagactaacatggtattagaaacaatagctagcatcattttgaaattttccatggaagaaggtacacatgcctcatgcagcaagggaggtcactattgtggaaaaaggatcaagggactttcgaagaatttagagaagaaatgactttcttcatatttccccaccccagactccataaaaaaagaaaggagagaaaaacatccccagggaaacaaaattacctctaacaaaaatttcaaaatcaagctaggtattttcttaagggaacccatcctattgtaacttaaagccctctcagtcttttctttaatcccacccccacccatgcctttgtggttattcacagatatgtagaccaggaataagaacacttccactggataaaaaaaactacaggaactggctttgagaactctcgggaagaggaagtacttctttctagttgaatggaaaggcatagccattcataagctcacagtttaatcatttctattacttcatgagaacatatgaatgtatcctcataattcattcttgtctcaaggacaactcacattactatttaaaatacagttttccattgcaatcaaaaaactaaatgtttcggtaagtcttaataattcaaacaaaaaggtgtacatatgtgcacatatatgaatacacatgtatatataatactatgtgtttataattaagaaagtatacgaagacagaaatgcaactgtgctatttgcatgtagcacttgttttatagagttagcagctttatccttacagtttcagcagcaggggtcatgaagacataaacacctttatgcttggaattgcacagagaactgattagtagcacaccaagcaattatttcaggggtttaataaggaaacagaagagaaacaacagaaaaaaagagaaagaaaaagaagaaaacctcaaacaaatgcaaagcacagttcaatcaatacagtaaaaatagaaaccaagatgtaaaaatgcaaatatacttacaaactccaagcctcaggacagattatactcaagagttgtcttttggagttaaacaacacattttaaatttttaacttttctatttactaacatgtttcagctacggtcactattaccaaaccagcttgttaactactaatataacaacacggaccctgcggcgtctcaactccccctgagcctgaatgaagaagcgatgccagggttatgtcattcctacctctgacatataaattggcaggagcggaatagcgagtgcccgcgctgttggtggcaacacactcatattttccttggtcagactcttcactctgctcaatctgaagggctcctgtatggatataaaatatattgccaaagagatgatcagagaaggctttctcagttcagaaagctaaacctcttaacaatatgaaaagccctgcaaagcgaaggtccactcaacgtcgattcaatctcttgctaagttgcacagacagaaaatgatgcgatgagaaaaacatatagagattattttttttttttacatcatcaatgctagcattagaaatcaatatctcttttcccaagcaagacttctagtcataattaacactcttatttcctagactaataaaatgaagatgggtgagactgcttcaaggaagtatggcttttaaataaaacaaaagattaatttttggttttgttttgtttcatttgggtaccaaaagtggcgcaaaagataggtacgctcaaaaaaaaccaggctgggttttcaagaaagtcttctgctgaagagagccaaaaatacgcagcgagcacaaaaaggctgcacaaagcaaaaaattaaaattagtcattataaattatcaaaatatcacttaaagaaacaaaactcccttaagacatgcagatttttaagaaaagaaagacagttttccacgacttacaatcatttattacgtttgctgaaaaacaaagagcagttgaattagaagatttttaaaaagttaaaaggcatggcctgtgccacaaggaagagccaaccaaccactgcttgaggaccctgagatggatcccctaagacacccatcaaaatccaccagtgggattagcagtgtggtgtcacaaaaccccaagaaaaatacaaaacaagaattacaaaagaaatgcacactgagtcgaagtatgaaaaaccagcaataccacataccaccaagaatactgagcaccttttgtttccatagcctgaaggacagaagatccaaaaatccggagacgagtaatccaagaaaaaaagaagtggggaaaaaagcattgctgtcagattgtagacgagtgggatcaggtggaaaggggagtcattctttgacttttaagacattaagagaaaaaagaattgaagaacaaaagcaaaaaccttttgaaagataaagacaaaaagcagatgctccagggtgtcttctgcatgtctgccactgttctccagaccaccttggctttggtccagaacaagaacagctaaggaagaaaaaaaatgatctttttttttctccggttggacaaaaaaaaaggaaaaagaagaaaaaaaaaaagaaaaaggaaaaaggaagaagaagaaaaggaaaaaaaaagagggacagatggtacgctgtgactggtctgtggtctaaagacctggatatgctttctttgaagcatatcacaacttaaataatcattttcataaagaaagaaatgaacaaaacaaagagagaaagaaaaaggaaaggaaagttcacaatatgagagtcactgatcataaccaaacagtacaaagaaaaaaaaaaagttgatggacattattggaatgacgctgaaaacaggacaaagatgagagggatgaaaggacagaaagaatgagtaagatcattctgtgaacgttagttcagcactcttacctcttattggtgtaccacctgggtggataatatgaatgcaaataagattagaaagaagaagcattagtacgagaagaaggaggctagggctggggagaagaattaaattagatttacagaattaaataaggtcttaaaagaaacttgaattactatattggtaaaacaggaatatattagatagtattattagatcataaaaaacaagttgcattataccacagagggtaaagaccgcaataggcagcattgcctttctcagagaagcaactgagttttcaggtctggggtcatatagggttagaattatatcttatatgcctcatatctcttaaaaaaaaactatacaatatttttaaagacatagtttaggaaaatactggctaatctatttaagtatatatatagatatgcatatatatatatactgtgataggaaacactaaagactaactggaaacaaacattgttgattggatatcttatactacttgctatgctacattggtgtgccataacttgtgtactatttaatttttctgcacagtgttcttacgataacagttctgtggaggtgtgtgtgggagccactacagagatctggtgtctacactgacagttagtaaaatgcatgccatgcattttattaataataataataatattctggatatggaaattagtggggttgaagtgcgcttcagaactaagcacttaccaatagattctggagatttaaatacggagagaagaaagacagcataaaaatattattatattccttataatttggtacaaatttttcagagttaaagctttatatactaaatcatctatgttacatgtgaataattaattcttcatttacaataacagaatgctaatctacacaattctgctgacaacaagcaaaagaggcagttaacaagacgctttaacatcacaggacaggtcaaaagctgagaattctgggaagacaggcagttaaacaacttagaattctataccaatattactaccaatgtcaaagtaaacagcttattattatatatccctgtgaaattacctagggacaggctctaaaacttaagaaatttagaattatctctacttttaatctaagagagcaaaggcataaacttgggatgggaatgggaaaaggagaaaagggtaaagagagagagaaaacagcaaaagctggagtctacaccaaaagcagacttctgtagatccagtcactggagggttcaaaaaccttgacgggcgcacactactgtggctaatgtgtagaaaatgttcactcacaatgttattatcatagtattaataaaaatcccctccttttactggtattttctaaagacttttaaaaacatacatctggttactcatgagataacgtttctgtgtttttatgtattagtgaaaagaaagcagatgtgcccagacttactaaactttggtactttgatgagttcaaatgtagaaaagatagcagaaaacatactttaataaaattgaaacattttagggtttaatatgaacattttattttttaatggatacaaccattggatctccttgcaagttctgaatgaagtccaatgttgaaataaatttgtttcaaaagaaaacagagaaagaagaaagaaagaggagaaaatggatccatcaaatactgcgaaaaagcagtaaattaaaaaattaccaaaaatacagtcacagcagtgagcaatgtggattaaacagaagctgcaaaacacacagagaaaaggagaaagacagactctgaaacaggctatgacatcacaaacatggaccacccattaagtaacagagaaagagaagagggagaaaaatcagtacctagaaataaaaaataaattaaaattaaaaataaggagagagaaaaattaaaaaaaaaaattctctaggagttagtagaaacagtaacaagaccctacctgatcgtaactgcttaatacgaccattgttgttgcttgtgtccacaggtaagaaatctttaaaccaagtgatttctggatccggattaccactggctgcacaaagcatggtggccgtgcgagtacgctcaaccaccttcaactgtgggcccatgtcaatggtagggaagcccctgggaatttgatcttctgcaagacaaaaggtgatagaaacattcagttaataagtcagatgctccaaattcaagagattccccagaaatctctctttaccttactcagtgcttgttgagaacctaacacaaaccaggcactaataaattagaacacagtcacaatgctgctactgatcagaagagtaaacactctatgtaagaggccaacagactaacacagagctcagacggggccgactatgatgaggggatgcagtgagttttccaagagcaaagagggagaaataattatagggtttgtgcttgagatcagtgagtacccagaggaagctctgatttaaagtaggcatttaggaaagaacacaatcggccaagtcacaaaaaggggagaaggagattttagaaagattcgggaatgtcacaagtgtaggcattgaggtaggaaaggttttgccgagagagaagcatggaagccaacagtgccagcttggagagtacttggggaacaagcagaagctaggtcacgctatctgtttcaaagctggtatgtttttcttataactctgttttccctcacaagtataaggttcaacccaaatcgattactttgtaagagcttcaattaaccagaaaattgtctgaggatgctttgaaaaagaagagcaaaagcaactccttattaatggcacaaaaacacatgttccttacagggataagagaatgctttcctccatcccaaagatctgcatcattttcagtaattaaaaagttgaaattcctaaattttgaatctccaactcatgcaaaattcactttttgctacccacatcgaaactgttccagatcccagctcttgagaaattaaaatcacttaaatcccacaatcatgctccacactgataactgacattgccagctcttctagccaggattagaaaggtgtgttctatctaagcatcgaaagaattttagttagatgggtggcaattatccaaattagaacatggccatttgtttgaagatcatgaatttttgttattatactttaagttctagggtacatatgcacaacgtgcaggtttgttacatatgtacacatgtgccatgttgatttgctgtacccattaactcgtgatcatgaaatatttttacttccaattgagtctggcattgatttaatcaataccccctcacggccactgataaattttcataagccaccaattctaaaattactcgaaagcataaacagcagcgagcagaacattagatatcatcagatctggcatatcgcttctccttgggtgcctcctacaagctccagtataatccatgaattcacagttgatggtgaatcatactgaggttatgttagaatttctaatgaagaagctccattttgatgcctccaccgtgttgccagtcaacagcatgtgttctccaactctctccctctagagccgaggggtaaactcagtctcctaaacctcactagcaaagtccttttcaatcaggtctcatttttctcagcctcttagggatcaactctctcataggaaatttttcttctgcccacattgaaattctcaccacttcccagacaaatcatgtttgctgggtactccgtgcttctaggaagccacgcagccaaagtcaccttctttgtaaatcttttccaaattctctcaaacatatttcattctttcctcctcagagctaccatagcagcggctactcaaatccactgtcttgtacttattaactcatgagtttatccctccacaccaggagttcttccatgttttatctgtattctgctcccttgcaatcatgctagcctgggtttccagattttaagagaaactccactgattcctaagcctaagtatgaatatatatcagtgactgtttaaaaaatatatatatcctactatgcagaacttctggtagagaggcaaccagttaaatagttagggaccagagagattctgaatgtgaatggcgaaagaatgtaagatgctaccaaagattaaagctcccaagaaagagaaatttcactgaacagatgcagttattgtaagataaaattgatggactattaaggaaaagcgtagactctggctctcccgctgggcaggatagaaagtttctatcttttactaacacagtctgtgaaggaccaaaagaagctgaggcaagtttgatttgacacctgattcatgacataataccttcctatcagaccaggtagttagggccgggtactaaacacacttataaaaataattaactgcaatgagctgaacttcacttaagttgaaagatgtggctcatttgtggaagcagtaatacattgtttttgtgaatgtttacacatcgtcagccaagcagaggtctacagtagacaagtgtcagaaacagtagttaaaaattgaatttcaagatgatttttcaaggctccaagagaaagttaaaaattaaaagtgggatgcaaattaggctatgctggttttaataatctattccacatgaatttcatcaggctgttctttatggctttaaaggttttgccaatatatttacatctacaacatagttctgatgttgctggggggaaaaaggagcagaaagatcaatagctgctataccacacacgttatgttattaaatatctcacttggcagctattgacacaaagtgcttcaaaggataaaagtaatttacctcaagtgctccaacaccaactataccgccttcataaaaatgagtttctgaaaaagctcttagattttgttgttgttatgttccatttttaaagcaaccaacttaggttaatcaaaaatcaccttgcgattcctgagtggtttctgtatgtcctaggacactgtatctctcccatggtgtttaagtactagttacatttgcctgcataaatactgctctgctagtcattacttttcttctacaagttcatctctcggaagaactgagccaatattcagtgctgatcagtggcaagtgccaaaggcttaagattgttaagccacttactaaaggctcttaccaaagaaatctagatttaataaccgtttataagaaatatagtcctcaccttggggatagccgacaaaattgacttgtaccttcctgaaaagcagtctaatacattttcatgacctttctcttccttcctggctcataaagaacactccagagcccccttttcatatacacgagtgcacaacaaagataatctttcttgcatactaatgggacagaaaatgtaaagagcgttcctttcttatttttaataagggtaattaaattctatccatccccctttgcacagaatctctttgaatgcactttcttcgttaaattttcatgagaaacatcacaatgtaacagattcaaatagccagagctgttacacgttgacagttgtggcttgtttccaatttgactgtcaggtatttggcaataaaactcagtattcaacataaaacaaactgtagaaataatgaaatttctaattggaatgcttatctccgtgggtgtagtttagaagacgttaattgcttttttcttcaccttccacatttattagtgatttatataaaactgccttggccatttgataacatcaattttgacggctcctcaaatgtgtggtaccaggaacttgggaatcaaatcaatatccttaataacttaaccacacaaactttcacaggaaaaagcagctagcaaaaattaacaaattgtcaatatgctagtagctttaaacttttacatgaggtgaaaagaaaaacattttgtcctattcattaatgtgctcattaagctttaaagtgccttacttatcactgttccatattaatattcaatcatgcagaattagctactaattcatcaaccatttaaatcagacttgaccttcacaaagccatttgttctgtcattttgagaggccattaaagggcagattactacatacttgtgcttagtgaatcatagagtcatacatattttgtttggaatggcagctataatagacctggaaatatagcaccctctttgaatctgttggtatcttaatgaaatatgctgatacaaaactttcagttccattaaggaaagagaaaaatgaatgtaagcatcttccagagttaacttcccattgtggtagaacttattaacaaccctgacctacccaggacttgaaaggaatgaatccatgaggaaaatagtctgacactgttttgtaggtagtcatgccttacatatctgtgaatgatcaagtaacaggttttacatgatttgttcacttaaactgttttcactgttcatgcataaacaatattaacgatgctcttactttcactccactttcacaaacactgaatctcttctttgtaaggaagccaggaaaatctgaattgcctgctaaggctacaggctccttccaaggtggtcctaagtagctcttcttgcctaatcttgctagggctcttgctgcgtgaattcaaccagactagtcctttgactctgaccccaactgatttaacgaagtcttcaataaagaactgtttgccatggtattgggaaaaatcccaatttttaagattaatacaaatatgtttataaagaaaaagcgtgtcaattacatcaattacatcaatgcttcttcaagtgcagtatttaaaaatttggcaagtatacctgaacacttagatattattgacaatacagaggttttggcagtaatggcagtacaataaaacaaaaacacaatatggatgaagagacaagcagctgttatcatgaagcattcatcccctggaattacttttctaagtttcaaacagttcagagtggctcctctttaaaagtccccaaatagtgttatcaataaaccgtaataatagttagtatgtaagtgtgaactcttacaagctcacaggagggcaggagctatttgttactttcttcgtaaccttcccaatgttcaacaaatactcacaattagacatttttatgatgctttgacaattactttttcagcactcactcatgaggtatctctcaattcctcctggaatgtcattcattgaaataccattcctcaatgccactcactgaaacagtcattcttcaactgtttgtgactacacatttggcctccttgagtatcagtctattaagaggcaaagctatctcatagtctcattattttagtgtcataaggagtattagaattagagacttaaaaaatggctgtttgtgactttattttcacaatctttagtttcgtcagcaagtgattttccttccattgagaatatgcaatttatgcttttaatttatcacggttgctatgtgagaagcacacaatttagtccttgcttccttcattttacaggaggctttccctcatatattggttttcagttcctacgtgtcagaagcatgaccacatgacaaaaccacatgtataaacacaatgacactgcaaagaacacaatagaacacgtatctatattctactgttattctatctatagaataacaatggaattcttggtgttgaaactaatggctaaaaaagcccaggagtgaaccactcagtttttttgttgaggcaaacactgtgggtcttccttcactgacaggaatacagatttctaagtcactggatatcttacggtttgagtcattcatatactctcacagaacaagagtgatttcttttctttgacgggtggaaagactgagtgagaaaagttttcattaacataagaaaacaagaaaaatgatagacgagtaatatgcagcgtatttttaaaatgacattcctagagtatatatatatacacacacacacacacactaggactgtcattttaatatatataatacatatatggactttttcacgtgtcagagaatcagtagtgttctatgcagcagaaagtcagtggatttttatacttaagaaaaagtacgaactttctcggaaaatttaaatacacattggtcttaaggtggtcaaataaggtggccaaatagatactttaaaacaagatatttatgaaaattacaccatatattgaaacaagaagataatttgaactattagttctaaaaacctaccggatagtcaacagatggcatcattcattctacaaatatttattgaaggcctcctttgtgctggactgggccaggcactgggtatgaagtaatctagataatctctatattgttgtgatttaattgtatctgcaggataattagcttctttgaaagtaataatagtaccaagcacatacacaggaagattgaattagatgatgcattaaatgtgcctagtgctgcctggcactagtgtctggcatctagtaaaatactagcatatatgtacttgctttattccaagctccatcaatagatctaaagggatcagaggcatgtgactctaaggcttgatcaaacaagtagtgcagcaataaactgcaaatgagaaattattctatgcaaatcataaaaaacaggggttatctagacacgcaactaaatttaaagcatagtgtttgtgccaagtaacctctgcaaagccaataaataccctcttttccctttgaacaagattttaggctctttgattaatcaacagtacaaataaataaaatccatattgtcagatgatttgttcctaaaaatgaattttaaaaatagctctaaatatttgggatgtcaaaggttgttgtgaacaactgaaaacactggaaccaactgtttttccctatatcatggcaggcatttttcttttagttattcagggaaggggcattaagtattcctcatcttggggagtaggtcatgttaagaaggctatatggctttcttaaagaaaatagtttttaaaaagatgatgccaagaagtcagagttttgttttttcatctcaaaagtttcttaacattctgaaaataactgtttggggaaaatgatataaatcaagaaacacctctgtacaaagtctccataaactagttctaatagctccattaattgttcagctctggagaggggaaatctctcgatgagatttgtctaatatgatgctcttactaaatcccacctttaacagaatggaatttagtcagaagatcatattagacaaatttaaaattttacctaatgcaaagcactataatgcccagtatctctaaaatacaaatatttgaaccttattagagttccttgaggtaaataaggatggtatcattatcatttttttgtggctataaaacaaaaactcagtaatattgttatttgtttcatatcctacatgtagtaaaaaattaaagaaagtctttcagctctagatttggtgtctttttattgtgtcatgtttcctctatgcaaattgctattcttcaaataaatcttcatcatgtagtgatgaaactcttaatcacagtcaactcatgaatgggacaacaaaagagtttgaatacttggtcatcctttacttttattttttaaatggcatggactagatacgcaagttccatgagatgtaataatactttaaaaatagatctacattttaaaaatccacatatatatacatacatacacacacacatatacacacacatatatacgtatataaatgtatatatgtgtgtgtgtatatacatatgttataggcttctcattccctcaggattggttctagaagagacagaattctgccatgtctgttagccagtacaaggtagatgagaaatggaagagtgtgaaaaggctgataaatgtcaagtaattttcctagagagctgagatttagtactgtgcctatacctttagcccttctgtaatttctacttaattacctaggaagggctgagaatggcgggccttctgccatgagcaggcaccaaaagtcagtacagagaccagaaaagcagatataagtagacctaacatatctaccctatgactttgggccacaaggtccctcttcggtttatgggactaataatgactactccaaagctttatctggacagggagacagatcagtgtctcagaggctggaaggcagaggattatcatagtgtatttgctactttgtcgaacaatgagttttcaagtcattacatttcaaaatgaatcacagtatcaggctacaaacaaggaccaccattttctttccagaatacagtccttgaagaagaggaaaaaacattcttttcttaaaggaaacagtgtaaataaagcttttattttcaccattccagatggcagcagggtataatttgtactgtgttgacatcatgaccattattattcaaagtcaattttcctgtaagtgaattgaataagggactgaaaacagaaaaataaagagcaaagaaataaaagctaaatcaccgttttctagcaaagttgggctcttgggccattatcgaaatgttacgcatatgaataaaattgaaaaaatcatatagtttctaattacaaatcaaatgctagtccagtcagcaagaaactatataaagcagaaaaaaaaactgacagttaatacatgacattccaaatggaacatacgataaatataagatctgttcccaaaaaagtaattatgaacaagatacaaaaatttttttcccaaggtcctctttgcaagttattacatacagatagtatgcttgtcttaatatggctataaatcaatcagctaagcttttatttcagagtagatttaggtatctcttaaaggcagtcactggatacaagagtctcgaaagatttctcatagaattatgccatgcaggaatagaaaattggacattgttaagctaagagcctcattagcagctactaaatattcagcataccaaccagctacccacagagcattccagagcaaagctccattttatgaaatattcctcacattttgaggagtttgcaaggtactccgggcagagaataaaacaaactgtttagaagcaatgcatgcaatcatcctacaaattacaaagtaatgtctacatagcagaacataaaccccagttagatttaattatcatttgtctaaatgtggtagctccaagtttacattgcattaagttaaggcatactgttattagtgctcggcctgagcaaatgattaccctttttgtgattcataatcaaataaacgcattgagaaaaaaaagaagtaccttctcctcctacctagtaacactattaatacctgaacgtttaactaaatacttaggcatcagggaaacacatttattcccttctttgggattcatttagataaaatccaatatccatccactttcacaaatctcattattccctatcaatttatatttatcaacaagcaggtgtcattatactcaccctttacatccatccaaatgtttaccttactttgaatattcaaataattaaccactttaccgaaatgtatatttaaatcataaaatgaattttattatttttagaaaataattttttattcttgttttttagaaaaagaggcacaaagacaaaaatagtaaacaaggaaagagacttggatttggatcctgcatccattatttgttagctttgtaaaaagttacaaaccaacaagctcaatcaaatgggactacagaaaacattcaatgtggtttcttcaccatattttggtaaatataagtatatatgaataaattttctaagccatcaaatgttataaaaaaaagaaaatcagaatcaattgtgtagtgttggattggaactaatagtgttggtgtgaacacctagttttaaatatatatgtacacacatatatatatacatttgtatacatatactatacatattttaaatatatatgtatacatatatatatgacttgtaaatgagtatgcatgcacaaacatacattctttatataaacttagcaaagacatcttccctagctgaaccaagagaggctgggagcagtaatacccagtagcaatggtcacaccttgtattcagatcttggtttctaaataccattctccagttgaaaggaaacactttcctttcagaaagcttcccttcagaaaactccttagagaaatcactgattccaattaggactggaacaagcaaagaatgagactggaacaagcaaggaatgagaacaagcaaagaagacacaacttatcctgttgtataagaaaatactcaaagaatgaaaggtatatactaaatgtacacagaagccagcttaaaggggctcttattgaccaaatattggacaacttgaacacgaaaattaaaaaagacagtattaacaagttataacacactgaataaaataaagacatgcatccatactgatataaataactgagtaaattaaaagtttcaggagaaatagtatctttacatagtatcaaagggactccctacataaatttattaaatataaagaaagcagtctgtgagagattaaatgatagggaaagtcttaagcatctcctagatttgcagtatgcaattagaaaccaaaaatgatgctccttatgctgctgctgatgccaatgatattaatttagaaaataatgctcccatttacatgattttgctgtattctaagcacggtagtagtcctaaaaataccattaaagacaaataattttgaagttttaaattttaaaaattttaactatttttaaaataataataaaatatgtaaagaaaaattagtaactttacattggagaaggcttacagaaacaaccttgattaaaaaatcaaagttaataacaccagtaaagggataattcaaattcttgtgctgagaaaaatataacatcacttccacaatattcctggaaaagagtcacaacctaaatatgaccaccagtaaacatcagcaaaaccccaaacaagaacattttgttaaataacaggctcgttatcttcaaaactatcatggtcagaaatgtcaaagaaagactgaggaactcttccaggttgacaagtacaaaatacaattctgaactggagcctctgtggaaaattataaaaacttgaatggcgataactggtgaaacacaagtaagaacaactggaaaaatgtgatcaaaagtgaatgcggatctaagaattagatggttatgatgcatcagtgtttacttcctgatttcgatagtcccattgtagttaggtaggagaatgccttgtttgtataaatctgagtatttgggaatgacaggcaaggcatcatgtcggcaattaactctctaacagttcaggaataataagttctttgtactgtagtttctacttttctataagattgggatcatttcaaaattttaaattatatagaagtaaactgttataattaattcatattatcagaaatatatagacttattcccaaagcatctgggtagctagatatactcaagcattgctttcccaattgtgacaaacattcttaaatatatactttatttgaggccctcttgaataccatgactatttaaatgacactccaactgttattaccaatttcacacaaatgatgacaatatctgaaaaaagttaactctaaaaatacatgaattcctataaaattaaggcataagtatttaattacaaacaatgaacaaaattgagtgataactcaagagcaaggtgcaagctcatgaaaagaaaatgtgagaaatcaatattctaataacataatgcacgtttattatttttatttagagaaatgataaagtctgataaaaatttaagatagaagacaaactttttgaggatcttccttccaattaaaacataattaacttagaatagcttcagaaatccaaatgttatttttttaagccaaactttcaaaaattttagaaacaatccaccttcccctcagctcatcacagttctctcttcctgaaacaagaacacattacagaaaatggttgttaccctctagtctttaataatgtaaggcaatgggagcaagaggaacaaaataaagtgactcagatatgtctaaataatttttctaaaaagagcatttcactattttaccacattcagtaacagtttttatagttttaaaggcaaactgtggtaggtatttgttttatctgacaggagaaaattgattctgaaaacagaggtaatggcagttttctttagagggtgtcttgaaagatgaaaagatcaaaatcttaaaacatcaaacatcacatataaaatgtttcactgaaaaaatgaaaactacaggagtacatgaataagcagttaaagataacttatatgtctcagaatgtattacagatctatggggaaacatttcccataaatgcaaatagttttctatttatatggcaaaattcagcctgaatttaacaccagagaataaccaaatggaactaggttttttgttttgctttttatagatagggtcttgctctgtcacccaggctggactgcaatggtgcaatcatagttcactgcagcatcaacctcccaggctgaagggatccttccacctcagcctccagggtagctgggactacaggcatgtgtcacaatacctggctcaattatttttatttttcatagagatgggtctcactaagttgcccaggctagtctgaaactcctgagttcaagtgacactcctgcctccactctggagcagctaggaccacaagcacataccaccatacccgtcttttcttttattctttttgtggagatgggtttttgctatgttcccagggctgctctcaaactcctcctgggttcaagtaatccttccaccctggccttccagtgctgggattaccagcatgcgtcactgcgcccagcctttgtgtttgtttgtgtttgtgtgtgtgtatgtcaatgtatgtttttcttcaaaatctttgaaatcacaggactatcaatttatgaaactgcccaaagaagtttacaactatgatttatttcttttcgaaatgtttgaactttcctctctatcaaaagaatatcatatataaaagcaaacacaggatagaaatttattcactatgctttcaaatatcaaaaatattaagaagctattcaacaggagttcagacatctggaaaataacccaatcaaagtaaaactgccaaacaatggccaaaaccactaccaaaagttacatgaatgaaatcccttatcttttgcaactagatggaagagttgtcaagcatccacataaattctaaaaccttgaccttcttcttcaatagattaaacacagcaaattagaaaaagggtttcaggcaaaacctgagggcatacataaaggattgcgatctttttccaaaagcaaatgaaaggaaagaagggttttgaaggtaaatacaagtgtgtgggcacttcggtgcttgcgggcatgtgtactgggagtgtatgtcgcttatcacaaaattggcattaaaaaatggctttttaactgcattatgaaaaatgcattggggaaaagcaaaaaataagaataaagtgatgtaggcatgttatttaggatagtaccgagatagccctgtggcaagataaacttacattaggaagatgtaaggagatagggagaagtggaaaaagttcagaataatttgaatgtcaattttacaagggttggtaatattttgaagatgaggaatgaaggagaattatcagggatggctttctgaaatgttatgattgtttgcatatgttttcagtcatgtcttcccttgggaagcaatgtcatgtatttgaggcactcatgaaacagtatgcctctatgaaggactctcaccaatagagctgcccctggatggagcacagcactaagtacaaagcaagtgtctgtcagttgaacactgatccagcttttccttcaggaattggcaaaaggggctcgtagagcaagccgtttgcctccttatctgctttgtctcaggatgaaggcaagaaatgtctgcttcagcctacacacgtgagctcagcatcctcactacagacgcaccagaagttccctgggagccagtctagaatgggttgtaaatacccatggatttgcatcagttttctccactaatagctcaattcctgcaatttgaagacagttgagcatgcaagggtagtttctccctagccagaaaaggaattcacaaaatattagagtatgacagccaatggtctcctgaataagaggaagaataatttgagttgtgttcctatgaagacatgaaattaagaatctccttatagataactcacggctgtcacattttaatatacaacatgccaattaaatagatataagtttccaatgataagatgatactcagaagcgatgtaataaaacctttttcttacatattgaaaacaacccagagctgctcattttcgtttagttgtaatagactgacacattgttataaatttgggaaacatacaatctctaattcttaacaaagtgacagcaaattgacaacaaaaaaagttttctcagccttgaattcactggcatagcaacatgacataatccaccaatcccccaacagccacgagtggatggttttgatgtttaccacaagattaatgccccttcaattgctcagtgatgatggctatgaggctgctgaataaataatgtatgtgcattcactaaaggaaggaagaatgtgtatttcagccactgatccctaatataaccaatgctatttaagtgtttgttgttaataaagataaaatactatgcaatacagctttgtatattatacacgacaggttttgtgagcaaattatagttacatgggcacatgttgtcatttttccggaattaactcagaagataaaatataatcaagaatgtttccccagtgggaaaaagacattttcttttcctttttttctttttgagacagagtcttgctctgttgtccaggctggagtgcaatggcatggtctaggctcactgcaacctctgcctcctgggttcaagtgattcttctgcctcagcctcccgagtagctggactacagctgcgtgccacaacacccggctaatttttctatttttagtagagacggggtttcaccatattggccaggctggtctcaaacccctgacttcatgacctgcccacctcagcctcccaaaatgttgaggttacaggcatgagccaccatgcctggccaaaacattttaaatttagttttattttcatggatatcatagcccaccatagtactggtttttgggggttgaaggttcatagacttccatttgctgggaacctattgggtatatcacatgcattaggctggtgcaaaagtaaggttttgccattactttttttttttttttttttttgagacagagtcctgctttttgcccagtctggagggcagtggtgccatcttggctcactgcaacttccacctcccaggttcaagcaatttgcctgcctcagcctcccgagtgatctcgaactcccaaccctcagtaatccgcctgtatcggcctcccaaagtgctgggattacaggcatgagccaacgcacccggtcgccattacttttcaatggtaaaacagcagttgcttttgccattgatatgagcaggaattaccttgcaggaaaataaaaaaaataactttttttttttttttttttttgagacagagtctcatctgttgtccaggctgaagtgcagggacgtgatctcggttcactgcaacctccacctcctgggttccagtgatcctcttgcctcagcctcccgaatagctgggattacaggcgccagccactgtgcccagctaatttttgtatttttagtagagacagggtttcaccatgctggacaggctgatctggaactcccgaaccttcagtgacccaccattgtcggcctcccaaagtgctgggattacaggcatgagccaccatgcctggtcgccattactttcaatggtaaaacagcggttgcttttgtaccaacttatacataagttgcatgatttctcacagacttaatcctttgacaataacagctgggtcatactaaagacagtccttttttttttttttttttttttaattgtcaggaggcacttttgtatcaaagtgccttcttcaaagcttaattcactttcctaaaacatgatgaccagggtttcagaacaaaactttctgggatattcactttcctggtgcttcttaatatgacagagacttaaacatattctagcacacacaatcgtagtttttaaatgtttatcttggttgtgaggaaaaaatgcagctagtggtagatttaacaaacagcacattgctccactctcacctctcttttactctccagaaataatttttgttgattttcaaattcatttcccaacatcatggatattattcgttttcatacttatattttgtccttgacaaagataatattgtttgttcagacatacagggacccatttctgataattcagtttttcgtgattccaaatggaacctgtaacagagttaatcgggggtacctggactccaggatccctaagttcatgagacaagctgttttctggattattcttctaaaaagcagatcaaatggaaaacttctcaacaaaattatttatgaattgcaggacatgaggtagttccgaggaaaaccatgtatcttgataaaacgtataacatttcctagaacagagtcaactatcactgatttcatcacagtgattttcagaaggcaaggactatacagatcaactgttttacagtcaaagtcatgctctttggtaaatattctgaagtgtttgactattttcaataactgagtctacagagacattacctcattcagtttattaaagtacattatttctactgattgatcaccattgaaagttcaaatggtgtttaaaagggccttttagctttaagttgaatgaatgacatggatacttgtttataatttcataatagtttttcaagtttgaattattatagacatactttatggtataaattggtcattccttaatttcccattaagcctgttcaagaagaaatccaacaaactttatacaaactctagctaaacgtagaagtgctcactttgtccacctcaatttatcaggtggctagcctatccaagcacataatatcaccaacctctttagttttcataagaagatgtacctatttagccttaacacagatcagtggtaacatctgagatgcttcacttaaccgaccacatagtgttgctttcatctgtacttatcagggatctcaatcttaaaatgacagtcaaaacaacttggccagaggagtaatatttatggagaattagctgaagttatgcaatttcatccactcctccatataatataaaaactgattttggttagctaaaggatgagagagctagaaaccaggactgttttctctcatctgctggagaacagattaaactgacatgtgttttgttataattcgacagattaacctgagggactttagcaagcaactgccctataatgttgtgaaattaaacatgcatatgatgcagagaatagcatttactatttgactatatcctcgttctcaagaactatgggagagaacttttcccctggtttcaggggaatattatggtttttctttcttttttctttttcttttttttttgtgagacagagtctcactctgtagtccaggctggagtgcagtggcataatcctggttcactgcaacctctgcctcccagtttcaagagattctcctgccttggtctccccagtagatgggattacaggcgtgcgccaccatgcctcgctacttttttgtatttttagtagagatggggtttcaccacgttggccaggctggtcttgaactcctgacctcaagtgatctgcctgcctggagcctcccaaagtcctgggattccaggcgtgagccaccgcacctggccatactatcatttttctaaagaactgatttgttatttatgttatggacatgatgcatctgtgtcacagtttccctctttctcacgtctagagatgttagtagatttggagctaaaattgtggtttatttagcaaaggcacagaagtccatggcatggaccgtatgcacgttccaactatactcctaacattaacctgtcttactacaaaattttcctgctccactgtcataccattttatcttgctatgtgaaacattcctccataaactcttctatctctttgaaataaagttatcatagacacaggcataaatattgtagatacaaccttttaaaaatatataatgtacaaaagtgatgatctgaaagatgtcagtacatgtccaaatgaatccacatttcccataacagtctgagaaatgttaaagtcacccaaagttatgctaaaccaaaaacaataaacttattaaagtgagcttaccagaaaggatataaaaaacttaatttagtaaacactaacttaaaggaaaaaataaaggaagaaagaaataaagatagggttaaataggcatagtgggccaggcatggtcccagcactttgggaggccaaggtgggcagattgcctgatctcaggagtttgagaccagcctgggtaacatggtgaaaaccagtctgtacaaaatatacaaaaattagcctggtgtggtggcatgtgcctgtagtaccagctactctcggggctgaggcaagaaaattgcttgggcccaggaggttgaggctacagtgagccgtgttcacaccaccgcactccagcctgcgtgatgaggtggaatcctatttaaaaaaaaaaaaaaaaaaaagagagtgactattatttctattttagaaaagtcacaggcattggatttaattccaatatcagcccatgataaaaatgataaatatcacaaagatatatacccacacaaaaatacatatataattatgtgtggatatgtatgtttgtacaaagcacatgtttacattacttgcagaaaattataatcacatttaacaaacattaaatagcagtgtattatttgttcaatttaacaaatatttattgaacacctctcagactctctgtgtaaaacattgctcagcacctgacagctgcaaaaacagtcccttaaaagttgtaccatgtaaggtgaaaacgtgcatgtgaacacagaaaatgtgtcaactaatcaaaccctaagggagcacaggggtgaataacgattttgctggagaccagagaaggtagatctaagagcatgaatataattttgatagaaatgtagtaaagggccttcaaggcacagggaaaagtataatctaaggtccaggaaagattaaataagtgcgaggtggattcaaggtgaaatgcggtcactgcttgaatgcttttgtttgcggacaggggtaggaagacagtgtgcaaggtctgttgaaggatgatgcaaagatggctggccaggtccaactgtgacaagctggaaggaatctggggttcatgtgttaggttgtatatgcatgcagctggaattttgttttttttttgagagaggtgttcactctgtcacccaggctgtactgccgtggcacaatctcatctcactgcaacctcaccctcccaggttcaagcgattcttgtgcttcagcctcccaagtatatgggactacaggcacgcaccaccaaacctggctaattttggtatttttagtagagatggggtttcgccatgttggctaggctgttctcgaactcctgacctcaagtgatccacttgcctcgtcctcccaaagtgctgggattagaggtgtaagccattgcacccagctggagctggatttttttttttttttttttttttttttttttttttgagacggagtttctctcttgttgcccaggctagagtgcaatggtgcaatctcggctcacggcaacctccgcctcccaggttcaagcaattctcctgcctcagcctcccgagtagctgggattacaggcatgcaccaccatgcccagctaattttgtatttttagtagagacggggtttctccatgttgaggctggtcttggactcctgacctcaggtgatccgcctgcctcggcctcacaaagtgatgggattacagatgtgagccaccgtgcccgggccacagctggatattttgaaccaaggaagtaaaagaaaaatcttcacattctaaaaagcaatctctgtcaagggagtgcagtgaagggggacaaagagaaagcccagttaggtagttactatattagtttaaatgtgagatgataaagtctatgtgcggatataacatagaattataattatgatcgttggaagagaaaggaagagatgagttagacgcatactggagaaacattccaccagttttagggagtattcattttacttaaggaaaaatggggtaagagtcagtgtcaagtttctagcctcttagttccttcgtgaatgatggtaggtcagcaggcagggatgatgtcactaatataaaagacacaagaagagacagagaaaggtcaagatttgtgtttctctcatatgaaaatgacagctggaatcatgcagatggatgagatgacccagcaaagaatttacagtgagaagagtatgggaaacaggggttttgcaatgttccaagtatgttttccacacagtaacatttttgcatattcctattaaataactaaaagggataagaacaattatattattttgcattgtagattttaaacatagagaaaaatatgtgtgaatatttgccttgtgaggaggggcatatgagaaagtaatgcaactttgagaggggagatgaagtaaaataaacacaagatataaaccccaagggaaattatttaaataggaaatataaaattattcaaattgtaaattatctaggaaaaacacccaataattctaatggtagcttaggatattgagccaattttttaaaaattattacaaaagaaagatactattcttaactcttgcttcaagccatgcaatcagacaaaaagggtaccatttcaagctctttcatttagcgtatctatattcagatctccattcatatagttcctggcatgaagcatctgaaagaagattaaaattaatgtaggagtgcaacattaagacaaacatcactgattaacttgaactgaaccaagctcaaagcaaaagccataacagggaatcagtcagaattgaaaagaacaaatagaagacttgtttagtttttactgtattccccaagaatttgaaaaatttagggtccaatttatattattaggaaaacaaaaagttgtttttcatgttctattggcttatgattgctctggccttttaaataggcctacattccaatataaatattgtcatgttcctaagattagtatagataccttacatgtatatggtacctcccaaatttgaagtgtcatgagtattaaatgatttaatgcatgtatggcactcaaaagtagatttgtcatatagtaaatactttaaaaatttactattaccactactgctgccactactgctactactagattgtatgagattaacagtaaaatcaaaactatattctgcattatttattataattagttgccctgaaatattttaaggccatcaaaatcttagttggttaaatgacctactggataatgtatctaccatacacacaaacagatacgtatgtgcttatgtgcacacacattctccaacataatttgtggaaagagtagcaacaaattaaagaagagatcatgattttcaatcacctaaataaatctaaatccatatgcaagagaaacctagaaatatggtataatgtaactgatagtataaaagctcagccctaagatttcttaatagatccattggccctatagtctacagctttaactatgagaactcctgacaagaacacccaaggcagatccagtgttcaatctttcttttgtacaggcctgggtcaggctctttagagaaataagaacgcaacagcaccaaggctgggtatgaaaagaatattctctccacgggcctgtcttcgacagtgagcttatgctatagctctcataacaattactcatcaccaacaatagcatcccagttctgcagtgacagtgtggttgaatagatttcactcctggcactcccatgataccataatggcaaatccctatgaaaacatatgataagactatcacttgggggtggtttttgctcaatagctattttattcccttggagtattttatctttcttcataattatatcaaagggtacatttctaataactggtaatcccttccttaagtgactttaacctccgtaggcattgggccccatgacccatagcacaaacatattttgtaattaaattttttttcaatttcagaagccattgaggaaatgttctgctttatataattgttctccattaacagacatttaatatgaaagttttcataatttaaacccatttaatctcatccttatatgcttcatatctcattttatttttgctgttttcaacaatcaaaacccttattattatagataagagagtatatggcagatcttttttctttctcttttcctttctcttttccttttcttcctctttgttttttaacgaaggctaatagttcttaactttagaagactaacaaggatgcaagagtgatacaatttttcaggagcctgaagtaccagtcattttaagtagcttcagattacaacctgtgtgggaaatagcatgatcattttcaattacttcatcatgaaggagaaccattaattagttttaactggaaattgctaacaacatttctacaaagtttataggtgtaataattcaattttccaaacataatgaagaaagtccacaaaatgttgactatgaggaccaaatcaacctctttttgcctagaataaacctgcacagactttatcaacatataatcagcagaatcaagcctggaatagatcaaaccagaaatgtgatccagtcatcctgttccaattaaagaatggaccatgtgttgaactaagcaaataagtgtagataaaataatctatgttgggatttgagtacaacttttctggctgtacttcaattgtagctaagatccaagttgaaaagttctggcaatactgcccccatacccaccatatattttaaaggaagctatcaatgacctggaccagaggcctgtgaccatcaccttgcttttttcaggcgatggtcacaggcacctccttgcacggtttctaacagaagacagaactgacctattaccaataaccacaaccctagcaaaacccaaatccaaaccccatttatatacaaaactgagaaaaggaaaagtcacagatctttggaaagtacagggttctttctctctgggaaaaatcattgtatggtttggcggtgcctgtcaaaaagggaaagtattagcaggtttctcttcttgctgtgtcagaacggaccagcgtgagagagtttttgacagagtatgacatgtgtttttggatttggtatccacttttctcccagagcactgtataaagaagcctcagtgaggtgcatggaaagaggacagaggcattcacaccaaaccaccttcattgcactcttcagaggatgaagaagcagccctgggagacttctcgcagcttcaggagaagattcatgatgaacggaggccaagcaaataggaaatccaaccagcgaccagatcaggtaggcagcataatggctgggactgaatatggatgatgacccttctctggggtgttcatgagcaatgctggaggaaagaagaagccaaatgcaaccccaagaatacctactctcgctttgccctctgtggtggattgataatgaccataaatttaattctgagttggctatatgacttgcttttgacaatggggcattagtaaatgtgtcacaagtagatacttggcaagtcactagcactggggctgcttgtgagccccacgactgccgctgtgtgacaaacacttctggagaacaattgcctctgttgctagagccaatagcatgccacatcccagacacattctgcattacccagccatcagctaccctgccacatgaccacagacccaagagagagacagtataaatcacttgagctggcccagactagaataactgcccagctgaaccacagaatatgaagaatcgttagaatggctgctgggttaaacttgttataaccaaaagttgagcaaaacactagtgacctgctttacaaagtatattatggcaccctatagattacaactaaactcggatcccaaatcaacttaaaaatgctatgatacagtttttgttaaactgtgcctttatagaaatattagtgaaagaaaaaaaggaaaacacagagtagaaaccctctacggaagcagaaaatagtcaatgtggagttgctctgacctcaagcagcttgaaagagctcaaacagtgggcctgagtcccctggcgtggcgtgaaaacaaggagcaatttggtttgctttcatgtatcttctgataagttgaagtagtggaatgcattaattccactctaaaataattaaatcaatcctttatttatcagtcgtttactggacacttaccctatgcaatcaactacactatctaccaggagatagtaataataaatacgaaagctatagaaaagaaatgagagaggggaactggagtatacctttatgacaggtacatgactcagcattctaaaatgtatgctctcatcgcttctcagccttttggctaagatcaagcgtctaaaatgtatgttctctttttctaaccataaagccctataagaaccttcttcttatgctcagagaacctatataaccctattttaataagctatgaccttgttgtttgcctgtaaattctatcctaacttaaggagatggagcacctacagtatggtacaaaaaagaaggcggccagtctcttacgaaattcagagagaaaaagaccacagattagccgggcgcggtggctcacgcctgtaatcctagcactttgggaggctgaggtgggcagatcacgaggtcaggagttcgagactagcctggccaacatggtgaaaccctctctctactaaagatacaaaaaattagccgggcgtggtattgcacgcctgtaatcccagctacttggaaggctgaggcagtagaatcacttgaacccaggaggcgaaggttgcagtgagccaagatcatgccattgcattccagcctaaacgacagggcaagactctgtctcaaacaaaacaaaacaaaacaaaacccacagattatagttggggaaggaaggatttaaaaaataaataaaagctttgttaacaaggaggattctgagttatgaggaagagaaataaatctgatattgctagaaatagaaaaaaatgattattctcatgttttgatatcacagaaattgattttaatatagaaatattttaaatatgggaaagtaaaaagtagggaaaaagtccttgttttcctctaaatgagctataaataaatatcctttgggtcaaggaacttaaacttggagtgtagcatgtgctgggaacacagagaggtatatgatcaccccataaaaagaagaaaagtggtttgactgacacagaggccatactaagtccaattgtgacacattaataggctaagaaatggactttgagtgccaggctattgaagcaaatttagatggctaggtataaacagaaatacaattttataatggttctgctaaaaaacagaaagctaatcctgggataagaattcattcactgtccaacacgtttgtttattttgacctgttggtccaagcactgtagagctgtcagagaaatatatgaagcagcacacagaagcctgcaaaccccacaaaacactaacatatttgtgtttttatacgctttctatcatttttacgggctttggtgttggaagagtaaggtgatccaggatcagagtccatcaagttgaaacttaagtctctttgtacttatgagtatatatgacttagctattgaaaatccaattatgtatatatacactatatatataaaaaattgttcctccagatacttgcttctaatttgctaaatgttactatatcaagagaataacatttcttctattataatttactaacttcccagaataagtcagatgcctcctcaaatatttaagactcaaaggggccaggtgtggtggctcatgcctgtaatcacaccaatttgggaggatcacttgagcctaggagtttgagaccagcctgggcaacatggcaagaccctgtctgtataaaaagacttttaaaaattagccaagcatgacagtgtgttcctgtggtcccagctactcaggagactgaggtgggaggatcctgcgagcacaggaggacaaagctgcagtaagctgtgactgcgccactgcactccagcctgggcaacagagaaaaaaccaaaaagactaaaagggagtaaaagcaaacaaactcttacttggtaatcaaccacatgttagctttgggaagctgagagttaatgcagaaggtttttatatgagtccatgtgtatttccccatgggtaatttgatgttaaacactaaatccaagtttctcagaggaacacagtctttaaatggcagcagtatcatcagccttgctgccttctggctttctatcatcttcctttggacatctctccaaaatgggatctggtttttattttagacacaacttagaatgcagtttcctatagtcaggcagggacaatgaggatgtcaatgaaatctgaagtaacaggaaggatgctttgtctacatctagaaagagagtctacacgtgtaggggaagcactggagcacagattgcagatggactgaaagtgggcaacaaataagaagactgataaacattccactggaccacgggtcaaggtccatcttggactttatattgcacccttggggaagcatgggagtacagaaatgggtcagagcagatgcagatctgtgaagacatcttcatttctctgatgtggaacaaggacagatggatgtaaaaaatgtgtcttggcggatctggaaagagcatgctaccctttgggaaaacatctgggctgttacattgttttacagcacagaaggcaagaatttcaagctctctcgccctgcttaagacttctgtcattcttacactactctgtcactgagaaagctaaaaatttattcaaaggtctcttcaatgaaatgcagattaaaggcattttgtgcatataagtctggtctcttaggcagcatttaactttactatgtccagagcatatgtcataactaatttgggtcatgtttgattactcactatgggtcaaagttgaaattctgttgcaaaacaccagagtaaacttaaccatgaatgtttttctaacagtctgtgactaaatgtgtaatatacactaacaacaacaaaaatctgtggccaatcatggactttctaatgcttggaaatggctgaaagtatatagaggatattcaaggccaccaaaatatactgtgctaaaagcacttaattagcaaaggctaactatacatctgcatgtacacatacttgtgtattttatatttctttatatatctgttagaataaatatgcatttaattaatataaccacacatttctttcctatccaaggagtccacttgcatatatacaagggtttgctatattataagaggtcactttcactatgcacttagttacatatgcttattctgtcttagaatgtacaaatttatcattttgacaggtaaaaaaagtgtaagaatccaagcagaaaatatttgaagttacagcatctggattggtaaggaggctaaaagagatagcataggtgacagaatcgaacccatgtctttcattgatggtacaaggtgagtaacctaatgaattagaaagacaagccaataaaaggtcccgagttgacctttatagtccttatatgcacatacatctttaaattctcccattatataaattaatacaatattggcaatattggttgtttcatatcagcacaatttgtagctgaaattgattattaggaagtggtttgtggtatacagtaaaggaggaccagtgagaggaaggagtgcccattcagagagcagggccacagtggaagggaggcagacagagtgatgcagtttgcttctgttagccgaggtacaggggaacctactccttgatgaagatgaaccactctggcgccatgaatacattgaagattactcagtggtcttgacaacggtcattactaatgagagcgaacttcctgaaatcaacagcttgcctaagactagcacagtgtctgatatgcagcaagaactcaatacatgtcatgctctgttattggaagcaaaatgatacctattctagtccattccaattttgaaacttattttagaaacaaaactctttatttttcatttgtaaatacatatatatatatatatatatatttgggccgggcgcggtggctcatccccgtaatcccagcactttcggaggccaatgtgggcggatcacctgaggtcaggagttcgagactagcctgaccaacatggcgaaaccatgtctctattaaaaatacaaaaattagccaggcatggtggtgggcacctgtaatcccaactactggggaggctgaggcaggggaatcgcttgaacatgggaagcggaggttgcagtgagccgagatcacgctactgcattccagcctgggtgacagagcgagactgtctctcaataaaaaaaaaaaaaaaaaaaaaagaaaaacaaaatacacacacacacacacacacacacacacatatatacacacacacatatgcatatatgtgtatatatataaatttataaatttgtaggtatacatatcaagaaacaaggaaataaacatagaagtaaagatcattttctacttacttaagtttactctaatttttttgtctcctttaagccaccactataaatttagagaacgctttattaactgtgaagcctgaaaaaaaattatgtaactaattaatctattatttctgctacaataagtgagcctttgattcttttcccgatatagaaataatgatgtgtgtcagacaatttttaaaaatgagaggtacagagagacggacaaagcaggccttgcctccctacctaggtttgactgttttaaactttaaatgaatactcaaggatttcctccaggatcattaattagctatttccttatgcaaacggagacaactaaagatgttttattttcttcctctatatcttctctcctttatgtttttcattcagccttgccaggaagaataaacatgagctgagtcacctgtactatttcctaatagtgattcatcaccaagaagcagtaacagactctccctcctttcttccctctcaggatgtggtaccaacaaggcaagtctcacagagccatgccacgtgccacatcctaaccttggattccccatatagcacctcccagagagctgaaatagcctggacatctttcaggcctgctctgatggagagagctcagaaacagccttttcacatgtgtcagattttcatctctctgaaacgtattaacagtttacatggcaggccagatgaagcctagaacccagacagtcaacgggcttgggctattgtacaaaccgttatctaataaaaaatgtctattattttaggtcagttgtcatcactatccatttagtttatggtgagtgttcatattaatgttaccaaaatagggtgaacatcctttatgacaccttatcttacgtgtaatcatgacttgacttacatgcaatggcgaactgaaataaaatggtaattgccacaaaatggtgcttggcattctaaaaaaattaaaatttacttcaaaattcctttagaggtaatatatattcatcagaacttatcaattaattgagtaaatacaaaaacactcaaaataataatattcacaagaagtacaactgcgtttaaaatctgaatgcctggcctacatttacatagtctaatagctaactgaagttttacttgtttctatctcttttatgccaaattgtttttattctgactgagatgacataatattttaattttcccagaaaagaaaaaattaatgcagaaaaaatcaacaaaaattcagttagaagaaataagttctagcattcaatagtacagtagaaaaattatacttagcagtaattcgttgtttatttcaaaagcgctagaggaaatgaactataatggtcccaacacaaagagaaatgtttgcagtgataaatatcccagttatcctaattttattgtacattatatacagatatcgaaatatcacatatacctctcaaatatgaactatatcaatttaaaaattcaaatgttcatattgtatcatgtgcaatcaaattttacttaatgcaattcactatcactttgaaacctgctcttgggctaggtttatgcttatttcatctgaatagagaaaccagaagttatcatccttaaataccatcctttgtggatgttcccatcatgaggacaaagtaataaatttcagttctcaaggatgagaagcccaacagattcactccttttctgcacacagaaccatgctggcaacagtcccaatgcctaagcttcagtcacaactttcagaaaggtgctatcaagtggggctgcaaaagaatccctctatcacctttcaaactgacacctgtgttgattgcttgagcccatcacagtttagctctcacagctttaatttactagcccatgagaagtcagcttcaaagaacaccatttcgactctcaaagaacattatcaatgtacatggatagcttccaacttcataaggtgtttctctctacctagagcaattaacattaatttgcagaatagtgtttattgaaaacctttgtgtatctccaacaaagtaatagtgtattgatttcattcctactatcttcaactgtatcattaagaggaatttcttaggaaagtctatatgcagtaagcaagtaagatcgcagaacatcaagggagaagtaaatccaaaactgattttacttcttttcttagtgaggaaagaattatgttttaagcttgcctctattcatataaccttaaaagtaatcattctgctttttgtgggtttattataatttgaacaatgtttataatctctcaattcaaaaaatcataatctgtacatgttgatcaaccaagttataaaaatgagatgaatttttaaactccatgcaaatctttaagagataacatgatctatctgtccataaccaagtttaaaactttgttgataacaaggccaaatgcaaaatggggggagtggaagaaaacaatacaggtaatttagacagaggcaagtcaaatgatcagtaccaacttaaaaaaaaatacatacacacacacacacacacacacacacacacacatatatacactgtttcattgtcaaggctctttcatattaagagtaatcaacatataattaaatttaaaaaaatgtatgtatagatgagtatccagctatataaccctgcagaggagctgaacaaagtcattcaatgaattgcagatgacatagcaatggaaagaatgaattacctttgtagttatcttcccacacccaaccattaaacaaacaggaccctttaaagactttaaggtaaacagtggtttctcaaagtgatgcaatgatcatgctgtgcctgtataaggagcataaaatgttcttcacaacagggttatccagtgtttagaaggaaatctctactggcaaatggatctgtctttttgaggttacagtttataggctggattcaaacgacaaattcctcaggactctttagcctaagtgtaaataaagatgcagaaaggcattcctttaaaaaaaaaaaaaacactccgtagacatggtgatgacagtgaaaggaggcagtcaaatgcctagtcagatggggcaggatccccttttaaactccacctccaaactgaagacagtttaaagcctgaaagccaagctaaaaattaaatccttggaccagactgagaacctgtcttcccatttgttgcactttgttctgattgatccccacccttcatgtattttacttatccctaccctttcctaattggttttctacactgtcctgcccacctttgagtggtgtcttcgctttaatcttttttgaatattcacataccaatcagcacatactcctcattctgagtccataaaaagccccagacccagccacactgagaaaaaaaccacccgactgaaggggtgaggaatcctcccaccccaccgctgcccctgactgtgagctgttccattgttcaataaaattcttctctgcccatcctcacccttcaactgtcagcctaccctcatttttcttggacgcaggataagagctcaggaacccccaaatgtgagtacaaactataacacaggtgggctagggtgcacccagctcagccatgggccaagccggtgtacaagcgagactcagcgggctgactgcctccagcagcaggcccagggctgagcaaggtgggggtgagggggggtggagagtggagggcacatcaccagctggaaccctgcaaattgtcagaaaattcctgcgtcagtgattcagtgatatataaattcaaatttcaagaattcattatttttataaagtctttaggaaaggatccttggattttttttttttttccattcaggagcagtgttggcaccattgtaaagggtaagggtaacggttgagatgtccaaatatacatatatatttatatatatttagtgatctaaatgtttccagtgccaaagttagatgctttgcaaaactataactcctttaaatgccatccatcttgaaaaaatgcatgtcacatcactagaatgttacttatagtcctactagagtttaaaaagatgtttcctaaagacctaccatttaaccacaaactgggaataacctaatatcaattggaaatgctgttaaacggaaacaaatgtaactgatacatttgaagcaagaggagattgaagatgaaggtatatatccaaaatggtgacagtgacagattctgattttcccattttgattaacagaatttcctataggcatcaataagctataaggtggataagatagttctgttgtaaaagtactgaggactcattatctggactctcaattctcattattcagtttacttagtttcataaaactttaagctaaatctatattctataaagtacatatgacaatattaattatattgtcacctttctaagattaaaaaattaagtattttttgaaaacttctcagttcctggcttggtttttccttctcataataatttatttatttatttattttattttattttatttttttgagacaaggtctcattttgtcatgcaggctggtgtgcagtggtgcaatctcagctccctgcaacctcgaactcccaggttcaagtgatcttcccacctcagccttccaagtaggtgggactacagacatgtgctgccacgcctggctaatttttacattttttgtagatacggggtttcaccatgttgcccaggctggtttcaaactcctgagctcaagtgatccacccgcctcggcctcctaaagtgccaggattacaggcctgagccactgtgcctggccaataatatgttttgaggagaaaattttaatgcaatgtaggttatcattaagattcatgtttttggtgttgtagctgaaaaacatttcctaatccaatctgcaaagattttctttttttttttttttgcagaggttttatggtattatgatttacatttagatctgtgagttaatttttgtatttggtgcaaggaatgagtcaaacttagtgttttttgcatatgggcacccactttttccagcaccaattgttgaaaaggcagatgagtagataaataaactgatatatccatgtaatggaataccatttggcaataaataataataaactactgatatgttgaacaacatgagtgaatatagaaataataagcctgagtgtcagcttggcacaagagtatacacattgtaggatcccatttatataaaagtctacaataaaaattaatatatagtgacagggtgatgactgtttgcctgggaagcgtattggtgaggctacagtacagacagccaagatggaggaattacaagtgtggtgaagtttcgcaggtctatgcatatgtcaaaactatcagactgtatgttttagatatgtgcagttgatcacatatcaattgtatctcaataagtatctatacatatatacacacatatgcatatacagatggtctcctacttacaaagttttgatgtagactttttttttttttttttttgagacagagtcttgcactgtcacccaggctggagtgcagtggcgcaatcttggtacactgcaacctctgctcatgggttcaagcaattctcctgcctcagcctcctgagtagttgggactatagacatctgccgccacacctggctaatttttgtatttttagtagagatggggtttcaccatgttggccaggctggtcttgaactcctgaccttgtgttccacccgccttggcctccctctgtcacccaggctggaacgcagtggcacaatctcagctcattgcaacctccaccctccaggttcaagtgattcttgtgcctcagcctccagagtagctgggactacaggcatgtgccatcacactcagttctaagtttttgtatttttagtagagaccaggtttcaccatgtcagacaggccagtcttgaactcctgacctcaagtgaatctgcctgacttggcctcccaaagtgctgggattgcaggcgtgaggcattgcaaccggcctcggcatacaattttcaaactttagacggtgcgaaagcaatacatattgagtagaaactacactttgaattatgaattttgatgtcccaggctagagatatgtggtacgatactctctggtgatgctggacagcagatccaagctgtaactgccagtcagccacatgatctggaggataagcaaccaatacactatatgtactgtgtttcctgattattttttctaactgttagctaatgtaagtattctaagcatgtttaaaattgggtaggctaagctatgatgttcagtgggtttgacatattaaacgcatttttgatttacaatattttaaattatgatgggtttatcaagatgtaacctcatcaaaaatcatgatgcatctgtatacatacacacatactatcaggcgtgtttcaacaatctttttaaaataaaagttgatattcaggccgggcacggtagctcacacatataatctcagcactttgagaagctggaggcgggcggatcacttgaggagtttgagtttgagaccagccaggccaacatggtgaaaccctatctctactaaaaatacaaaaaattagccagatgtggtagtgcgtgcctgtaatcccgctactcaggggctgaggcaggagaattgtttgaacttaggaggcggaagttgtagtgagccaagatcgtgccactgtactccagcctgggcgacagaatgaagactctgtctcaaaaaaattaaaagttgacattcacaatcaagtcatgttacattgatcttgattggacaagaatctccggaaatttttatttatccaaatgcatatgtaggtatggtgggttggtgtgcattcacttattggagggaagagtctaagaaagttttttttaaagggcctaaataatctaagcaaaataaatattaatccatgctagccacattgtaagtgttaaaatggaaagaaatcatgagattctcaaaatgtagccactggttggataaaaatcctcagcaaaatttgtctctagaaatacaaaagctccttcattgaaaaatgccctcaaatgaaagtaattatgaagctactcacaaaattagaagtaaaaactcaatgacggggagagacgaacatgtggccatgtaatctgctccctgctcgtggagtttcaagctaaccgcagtggttttgagtataagaaatcatggtcacaggaacagggaggaagtgtggaaaggggtgggctggaggaccggggagtttacactgccagatatgacaactcttcgcacaatgaagtttgaaatgtaatcaactgctattttaaatttgacctttttttccctagaatagtaatttcctatagactgctttcatgtgagaaccatatttggttgcttaagaaataaactattaattcactacccacagaaaggataacattcatttgttatcaaatactaaatgctgcacattgcattagactcgaatttgaaatgtaattcctatgcatgagtagtgtttcaggaaacatttgcctcccatgttttctccccttgacacttcacgttttagatctttgttgctaccatacagaaataggtgcatttggtttttaaatactggaaataccatacttgacataaaaattatatgaaaaagagcacatctaaaatggacatcaagaggaaggaaaaaagaaaaaatacaacaaaagattcagtttcttccattaattataaatttaaactgctaaagatcctaaaatatttcacctttctggctaattgttctgcatagtttatgagacgcttatcaaaaagaactggggtaagttattcatcaaagttttatcattaatagcattaatagcaaaagcataccttttggaaccatggaatattacagaaatagaaagttgcagttcaaatgctgtttgtatatagagagaaaacaagaagacaaattttatgagatttcaggtacctcaggactggttttgaagtattatagatcaaatatgtgaaggttataaaccagggctcccaggtaagctggtatagaacaaaatcaccagtggaacagaaactgaaaatacttccgctgaaaagatatatactgaatgcaaaatatgtgtgtgtgtgtgtgtgtgtgtgtgtgtgtgtgtgtgtgtatagcaagtttcatttatagaccaatgcattctctttggcaggggtagttttttaagctactgttagaaacatatgaagaggggtgtatgtaggagaactgcttgctctagggttaggtgtatttctacttcaagaagaaagccacccaaagaattgctgtttcgaaatctgtacgaatagctgagcctctcttgttttcttcactcatgttcctaagtaacagacagcagactaggatacttgggagttacatcccttatttggctgtttgaactataagactaacagcatatcaaaagctgatcattaaaccctcctattttgataatatcctcagtatgaaacagcttagtgaaagacagaggttggccctaacagcaatgttcattatagccataacttcacctctgagtagggcaagagttgaaggaacagatctgagtagatcaccagtagctctcactaactgaagcttcttgagggcaggattatccaattcatatttgatcctcagcgcctagcaatgagactgaaatacgttagacactcatgattatttgccaaataagaatggagtcaaattcatatccattgtgaattacccagaaactatacattttaagataaaaagtgattgtaaacatagttccagcccattcctcttaaaaattctagacaaggtatattgatggtcaaatgttgcagttctcaaaaagtctccagcctggacactgccttgggtagatctggtcatcagtcctggttgctgctccaagtaaaaacttcattcttgatttggggttttcttatcacctgaaatacccttttgcaaggtatgtttcttacatctctcctcacataaactccgtaaaaccacccctctcgaatgctaccttctccaacgaatctctcctatttatcttatttgtaagtaatttctccctttcctaaatgacacaatattttatcagtacgttataaacaatgtttcacattgatgcaatgaataactaccagaaatgcaaaaaacacaaacaatgcagatgggttccatgatgaatttggcggtacctgccttttccaggcttcaaggctgctcttatttttcattcactctattgcttctgcctcaaatatcacaacctgcctgtaatcctgttccctcctctcagacaaatgttctttaaggcatagctcaggagtcactttctccaaaataatcttccctgacctcttctccaatttcagatgagtaaggtgttgttaacgtgtcctactcacctgcttccatagtaccatgggcacatgtccttcttcactaaggataccacattgcagtgatctgggaaagcacgtcttctcactgacctgagttctttgaggaatggaatggcacagtcatcatggtatttccagcattttgctaggcctcagtgccacagtggctgctcaatattttatgaataaatgaattcagttatatttgcgtgtaatctcctattctagactgtgtgctctttgagctcagtaaattcagtatttttggtacacagtagatatttttaaatgcctcaatgaatgaatgaatcatacaacctttaggctggaagtaattatagatatttttagtcttatttctctctcttacaaataacatatgatgaccaagctaggttctatacatttattcatggaatcaggatcaaggcataggtcttcagattccaagccacacaatttattcttgtatactgtgacatttttgaattaattaattctatatgaagactaaaatattaaagtcatcactatgaatatatatttagaaatgagaccttattttcacggaaatttaacaaaactggctgtcaaccatttttaatggattctcctagtatgtatcagaggctgacagttacaggcaatccattataatagaaagagaaacatgttatattctaaatactgcaaattaatcattaataataatttaaaaatccaatagattttggtttagtcagcaaaatgttttaaatacaagtgttctatacattgcagagatgctaagttacatttaataccatttatcaaaaccttagggagttattctttgggtctccaaatctcaaagacattaaaccaggaccaagaatttcatgaatactgtggcagattcctccctccctccctctctactaacagtgatttcaaggcaatgtgacagcaacttacacattacctgtcaatagcaatgacttagccatcatctccctggaacctttcattcctattactcctaaatcacctataaagaaattggtaattaagctgctagagacatctgggctaaatggattttgagccaagaagttttgaaaggctgattattaaccttcggtaaaacacaattaagagaacacaccagactcattctcagcttcagtaggagagaaaggtcagggctatatgtgtctggtagatttaattttctatatcactattagacagcctagattatttttaatctggttacaacaacaaattctactgatttttgaatcaaaagtcaaataaaaacctccagtataaacctgagttttctgcaagtattttctttcagaggcataacagtctccattttctacagaattcataaatatgaatattttagaaaatgtctataagtgttggtcttctaagttctcggtgctgcctaaagtaaatatggtaatactcagttgcccacctatgagcttttgtgtgtcattagcacaaatctaatgcttcatatgcagcaatacaaacactaacatcatttcttttatatagaaatatgcttcccaagtttaagttcaaaaacacatctgactttaaacaaaatcatgtttgttgtcaatgttttattctctctcccaaaaaccttccttcctacctccagaggcttcctctcccaaactaacacatctttcttcagcctagggagttcattttaacccacgtaggtgaaactctctttagataccctctaacaaggagggtacaactcctcccaccccaagaaccgctatctcttccagccttaaaacttccagaggaaaaggttatgctagtggttacagaaagcaagaccaatattttgcagaaggaagcccattctatccaatgttacccaaatcatatcaggcaggcaatcatcctccaaactgcttgaaattatgaatgcagaaattaatgttaaaatgaaaatgcctatagtcctctgctacagacaggcagagaggggaagaactttactaacctctacctcagaagaactctttctctttgaggaggaacatcttccataaaaactggagaaaaaattgggccttccaattatcacacatctccgttcccctcaacaattggtgtgtctacagtcccctccatctggtagtgatttattttcaaaggatgaaaattaaaaagaatcacaccttgcaatttggcttatcgattccttttcatttatctaaactgagcagtcatataacatccttaagaaaagagactttaaaacttccactgcttaaaaacatccctaaaagaaaggacttaagaatcacctctatcaaagaaagtttgtttattattttaaggaagatataaattggaaaaaaccatactaattagaaacttgtaaaacttccatttgaattataaattcatgatgaaaactaatacaacacaatatttggatattttgttatacataatgaaagtttcagatttgggaaactgaaaaatacagagcagatatcaacaacatttgggtacataatgcggtgaactgttagaaaaaccacagtttccgtaatgaagttgtagtggaagtacaatcaccatcgcataagtagatatcagccaccatactatgcatcctcttacaacagcaagaatgactgttcctatagcagagatcgagtccattagaatttcaaccactgaaaaatgggttgagaccacataatttgctagtatatgtgacttcattatattaaatagggagatttttatatgtaaattgagattattaacagtaatggtcataataaatacactcctcataatttattgcacttcagtaacatactatttgccacaatacaaatactttcaaaatcctaacaagatgtgctcaaaactaaattgcaaaacaaataagccaccacctactgttaaaggttagtttaagtatttcaaaagcaacaatttaataaagattaaggaatttaataagcttcccttttcctttaacaaaaaagctttcaagagtcaatgagcaacaacaagaaagggaaaacactagcacattaaaatgtggtgtgtaaagtatggtaataaatacacttaagagaggtaggttttaataataacaaatacatttttttttacaccaatgactgcccgttaggcacattcttaagtcaacttgcatggttgtggctatttgtcaaaacttacttcatcatttacagtctcagagttcttttccttttagctcaatgttgtgatggaatcaatacagatctgctcttaaaatatctgtctctgacctgtgtttgttttaagctgtatcattcataatggtgatggattggtaatgctattcctctttgtctgcacaaagcaccatggcataaaaagcacatatattttatgcccaaggtcaggagaaaattaatggataaagagctagataaaatggagttcaagctgaatgggctgagagcgctctacaaggtacagaccaggcaggcagtacaaagtccattatacttaaacactcttgaagcatttcagaagtgaaattgtttccacaggctaacacataaaagcaccaagctctcacatggcttccactgagtgcccacaggtatgggcaaagtactcctgctcacgagcttccacggcatattccatttatcaatttttaccttgagcaataagcccatttggtgtttatcaccagagttgaacaagttatgctttgttgtcattagcaaacttctcttttaacactttcctactaattctatttctattgttcactctcttactgtgccttgtgaatacttaagagtttagggtctcccttaagaggcagggccagctgattccaacaaaaacaaagcttcatagctaacaattacacgctattttccataacatgcactctcagacatctaaatggcagcaaactaagtagaaatttaaaataataacaaaaacaaagaccagtaactgagaattctaaagtttggcatgcagaacaccatcaaaatcatccatgacaatttggctgataatatctatgcataaacataaggaaataagcattttgcctagttaagcagtccaaaaatcaatggttttcttcacaaaccttgctgagaaaagcaatattactattttgttgaatataaaacaactgagcaaagccatattagaatttatcctaaatacctcactttcagatttagaaaaacaatatttaataaatagatagtgtaagtgggttcttccatttgttcattttaaggggaatgcatagtaacagttgtgatttgtccttatagttgagccttcaaccctgtgacactataaataaactgctcctggagctgcggaaattgcccattatctccaagagcatgttctgataagagtccatcaacatgaagccaaaactcattcagagcatcaagagaggaaagtttctagtgatggtttggtcatggtctctttcaggatgattgcatggcagaggaaggaataaaactgtgaaagaattaaagttggtggatgcggaagtaatgtgtacagtgatgatatagatattaaagccaaaatgtggcaactctgtttgacaccgcaaagcaaaatgcattttttcacgtaatttagaaatatattcaggtagcactcaaagagctcatttaatattaaatataataggcaagttctgagtgtcagttaaactggactgaatgtttgagtttgtcataaattaggtgtggctcacccaaaagcataatctttccattttagtttctttatttgtaaaattaagagtcagaatatagcctccaaggactcttctacctaactaaaaagcaaaaccaaacccttccaaatatcttccatgatattctcttaacataaaaagtcccaggtttatgatccaaagatagagatcttggcattttaacatgagtgcagtgacaagactttctgacctgagtccacagggcagttacacacataaaatgacttcagggaaactcttcacttagggaaaaaagcaattatgaggaatttgtaagtattataaaactatttttaaaatagtaatagaaagctgaaatgaagagtaatggtctaaagctaaaaaaaggaagaaattaacattagacaacacaaaaattcttcaaggggaattaggcactagaataactgcttagagaggtacttgagtcaacctcattggaggcattcagaaatagattatatcaaaacctagcaggaagtctagtgttactccttaacttgaaaaaaataaaaaacaacgtagcacatttccactacctaacttaccatattttgcatattattttccatatatttcatattactgtgtatacttggtgctctgattatattggtttgcatgattctattttcacatatatcctaaatatttccaaagtttcaacacactgttattataagcttaacatttcaaaagctggttaaatattcaacgttgttgatatattttaacttcttattctggtaaagtacatttagattataatttattgccatcatagcaactcctatgctacatatttttgttcatgatctgttggtttctatcaaattgaatcctcaatttaaactcctatgactagaaataccaaatcaaatgagtatttcacacctctggctatgtattgctacttctaaagccctaggtatgaatgaatgcatgacaactcagtgctgccattttaacatgtgctgataatacgttccaaaaattctaaaaaatgatgtgcaaattttgttattctcttacataactaaagaaaggtattggtgctactaaagatatacatatttatttccagtatgtatttaatatatttattcctgaaatgaaaagataggcaaagtagttttaaaataatctataatagaacactgctttaacagaatgaagacagacttaaatttcttgagtgttaggaaattggggagaccctggatcatctcaaacaatactgaagatactcttcacaagtcagttcactctgggtcaatggcaatcagccagataaatcttgttaatattaaaactggcttaaagccagacagaattcatttttttctcaattaaaatagatggagccatctttcttgactattaagcatatctctaatgttcacaagcctgcctttgtttcatttcctctccctataacataaaaatgataaaaaatattctctttatccaaaaaagttgcataatttttatcacattagaaaaaaagcatcagtaggagtatttatggaacattactcttaattctgcatttttacctatgcagaacattttgtaaccagtgttcaatattatgattaaaacataaatgaggttaatatttacaatttgtttatatttcaattagaacaattttagaattcatgtgtgcataagcttggcagaaaataatttctctaatgcatattttaacttcatttagggctgactatggtaatactaattattcatccttgtattttcagatagttggaagaaatggcagttccagggactttctggttcctcctcagtacaaaaccatttatatcatattctattattgctccatctcaactcctgtgcaaacctattaatacctacagatactgcacggaacatgctatgccattcacaatttagtctttcagattgaaacatgtcttaattcatctcaagaaaagactagaagaaaatggtagttgcttcttaaaattaccaaaatcatgatcatcactattaacaactgataatacgccataatgaacactctttggcactgtctatcaataaatattattttaatttaaactattcattttggacatcatctactattgtagttattataatattgtcctctgataaaaacatctgaacattttaattcatgatgatgatagttgggaggccctaaaaattggtccaacactttaaaataatgtataataaattaaacaccaaaaggcattaagcaataaaatgtccattaaagcactgtatctcagcagctggaaaacacctaggtggtatatatagcaaaatataagtatcaaatatttggtggtacatatagcaaaataaaggctaaccactaagaagaaaaatatttttcttgcactttccacatactttgttattacttttaaagttcaaggcatagtttcctgtgggttcttttcatttttcttcattcagtaaaataaatatccatcttcagccagacattcattcctccccctgagctattaaaactcaattaattgcttagttaattgccaatcccatttaaacaactcactgctgaactccaaacaaacttataaaatgaagtgatatgctgagattcataagcagtcacaaatgtaaaaataaatttaaaaaggaagaatatgcatgcccaagaagaaatggcttcattaattaaaaaatcaatatcatataaataaagacaaataaaagcaaattaattcaaccttggcaataaaggcacaagataatttggtcatctatttcattaacgcgtttgcaaatagatcacacttcatcagagggtttacagaactgtcctcgtactctacgaatagctgttcaagtagttcaggctgcaaacaagtacaagacttctgaccttctacttaaacagaagtttttaaagttggtgattatatatcatttaccaagagtaagctaaattgttcctgaaattaactcaaatcacttgtgttcatgagaaaaggaaaaaggcgattatatatttatatatttcaagcagggtctgagtgaattgagtatccagtaccaacacactcaagtattctttttagtccctaaccgcttacttcaaattttcatagaaaaagcagcaatttaattctaagagtatatcaaatgcattaaatagccctgtacggagtggccaatgtactaattcatatgtgctggtgaactctttgcctgttgctgtcttaattcttgaaaataaattacaggctagtaagtatccttcgttactgtgacctccctcaccctatggattttaccagacgataatctagaccagtgtctctgcaaaaacgtggctgcagaagagatatattcgtttatttggtaagcaacaatgaagtacttaagtccataaattttccattacaatgtcagaaaaacaagaaggctcactttttgctcaagaataattcagaaaggaaaaaagcaactgctcagtttttcaaaatgagtttaagttgcaaaaacaaatgggaaattgtgcaacaaatgtagtgactctaagtcataaatgcattaacttaaatttattaactacagtacctaccatgtgctaaacactgcacagggtaccaaagatgcaaagactagctagggatgcttcctcagagggctgaactccataatcgactctgctatacaggagatgtactacaaagatttcagcagagaaataacttaggtcagtttacatttacaaatgagatagtcctaacagcctttaaatccccacatgttgtaatggatgatacttagtatgcatgaaagcttgggagcaaataatgtttgcacaaactgtttatctatccttataacaccaaaccttgaagtgttggaagattattgaaggcttttttttccttttaaatattaatgtgcacacttttcaaccaattgttggcatagaatacctgcagcaattcttgattctatcatatttataaaaaataatgtcaatacctataataactataaacacataatactaagttttgttttatggccattttgaacttcctgaaataattctgcatttaaggcagacttccaaatacaatgaaagactcttactgatatttgtggggagaaataatggttcttttatggtcatgatttgcatttttacagattatctattatactttatgtcttttccaatgtttcctaaagcttcacattttggttgtattgtaaaaccaaagtaaacaaaatttctacaggttaaggtcataataattagagttatgtgtagttctctttttgtgtgcatatatacacccacatacatgtatatagatatttaatcttgtctttgatctacagcaaggctaatgcagcaaaaaaaaaaaaaaaaaaatccatatttgcatatccgtgtctctttcctaagtatctctagttgcatgtttcctgaaaagagcaaaattcaacagagccaaagtaaattattccctaccaccaaaccttcacagatatgttccctgcaatcctaatctcagtgtatgccacctataccaaaccaatgccaacccagaaagcatctttggtgactctcttccttagtggcaatattcaactgctattgatgctaccttttgagttactgtgtatctcttcttgccaatcccactgtcagcagagccatctggacctttatcacctgttgtctattttaacttcagtactaaaaccctccaatccattctccttccacaatgcagctagagccaagcttcaaaacagcaaatatattactaaggttttcctgattcaagtctttttgcttcaaagactacccaaactctccagcttccttttttccactctccccaccatgacctgtactccagaatctgagctaaattagagttctgtgaatacacatcacttgagcatatgccattcttgctgcctgaaagaacttgaactcttttattttttatttgtttgtttgtttgtttatttatttatttattttgagatggagtttcgctcttgttgcccaggctggagtacaattggcgtgatcttggctcactgcaacctccgcctcctgggttcaagcaattctcctgcctcagcctcccgagtagctgggattataggcatgtgccaccacacccagaaaaaattgtatttttagtacagacagggtttctccatgttggtcaggctggtctggaactcccgacctcaggtgatccgcctgccttggcctcccaaagtgctgggattatagacgtgagccactgtgcccagcctacctttaactcttgttaaggatctctctcaccaagagatccttcaagacttcaatcaaatcctacctccttttgaaagcctcccctgacttctctaacatactgagcattgcctgtctctattctggaaacgactttaatacatctttgttattctacttatactcaactgcagtagctataaatgatggttccagagcagcagcctctgcatcacctgggaactcattaaaaatgcaaaatctcgggccctactcaagacccgctgaatcagaaactctagggatgtgggactcagaaatttgtagttcaacaagcctttcaggtgattctgatgcgtactgatgtttaaggaccccttttctattgaaatcctgtgtgtccatcagtctctacacataattgagaaggactttgatggttttcatcttcctttcattcttctgaatatgcaatacacatttgttgaatacagagcaaataaactggtaattaaaattagaattttacagttaatttcattgcgctttatacagatacagattcttagcatgctatcggtctgtacataggatacacacttgaaatgtgaagatgatcatgtcaagacgatagcagatatgatgcattgccaatagttttcttatgataatattcaccatgaaaaatgaataagatcatatgaagttattttcatgttagacaatagggaaacttaaaagatgctactaagagtcaagggccatttacaactttttaagtaatcaactaggtatactgttgatcgaacagagcccccaccctccaacccctatatatagtctatttattaaacagagtttaatgtttgcccttcataaaacatttcgtatataactgatattaaaagctgtaatactattatttgattcataatttaattcggtgtttgcaaacacgtgaaacaaaaactcagaaaaattctctaggctgtcaatacaacaaaatgctctacctatatgttaagagagtgcagaggcttggttatcagccagctatgacatagatggggctgagaagtggaaaggcaacaggatccgcccacactagcttcaagtatttagacacatatatctaaatggcaaagtgtttgaaatcaggactgggcttaacatgttgtactttattccccatcctcaagtgtcaattacaggatgtctgcatataatagttatttaacatattgacttaaacagaatttccatgtaattcttctttgcttaccattttgattaaaaagtacaggagttaaacttcaaattacatgaaattagtaatttaagttatttaaaagtcaattcatctcaggcattgtattctgttcctactattgtgtactacttctgtcactgatctcaatttataaatgtattaagctggatttataaatatttcagaggtgctctaggacagagatgatatatttttacctctgtatatgcaacacttacaagtccaaatctgtagtcgattttaaaacttaataataatttgattaataaatcatagcaaagaaacagggagaataaggatattgctatagcatggtatcatctaaaatcagttgatagaaacaacacaacattttctttgtaaatgtgaaagcactgcttaaagttccaaccaactgtccatctaatcttttccatagcttattcttcataatacaaaagcttcttttctcttggatctaatgctaatgctctcctggtatataatcctcagtaagaaataattttaaaagaaaagatataataaaagtactatccatgaagttttaaaactggaactttgctaaatatattatccttattagttttaaataccttgggtcaaaatatgcccaagaaaaactggtgactgttcattcattccacgttcatttgttcacactgacatttattgatcacctgctcatgccaagcattttaataagtcctgggcaataaaagtataaaaaacccacagtgcctgtcataaaagaagtcacattctaggggaacaaaagatacatatatagttgcaaaccaaagtattttaatggaataagagacatttacataaaggtattatcaaatcaaagtagggtattgaccagatctgggaaaggcttcatagagtaaggttgcagtggatgggaaagatttatcaggtgttgtaaacagagaccaggaaattaagctgaaggagtatcatgcagacgtaccttggaaggaatgtagtatgttagatggaaacggaaccaaaagtgttcatgatgggaagaaaagctggtgaggcaagtggaagcctggtgaccaggctaaacagttccctctttttgccacaggcaaaagtgaatcatcagaggtgtgaaacaggatagtggcatgatcagatttcactcctgggtggtagctatgaacattcatcagggtttgcagggattacaagtttccagtcattccacaaattattgaccaaaaaaattatattaaagggaaaatatatttctattaataacaaatgtgtcatgataatgtcaggtattaagacagaatatacgaaacaaatgtttatggaaagtgttatcagtagcagtagacatgtgaaaaaagactagtttgcctttggaaagataaaggaacaaggtaatatgcaaagaaagcaataagcattagagggagataactgacaaaccaagacagatccgaaatgatacatgactctaaaacattgaagcagtaataagaaaatagtttagaacaaacagcctaatcacctgaagtaatagacctaaaaagtggagtgacgatagcaattaagtttctcttgtagaatatagacccaaggtatgagaattttctttctttggttttaaatatatgctatatatgctgccgtctgcagaccctgatggactttttatttttgaaagtgaatacagcacctgaatgtaaagataccaaagtacgtgatagtctgaactatcagggaagtctttgacaggttaattaaaaagacttaaacttgaggtgttgtattccttatgacaccatttttagcactaagtagtgagtgatgagtgagaaaattgtgtaattattggaatagctaattggtggtaggaccatttgtaagtacaacaaaataggtattatggtcagccagacaaaagcagctatttgtatgtactcacgcacacatacacacacacacgcttatataaacagcaaatagcaaatgtggatacaatttttcgcaatgatagaaatactgttttgcagtgatcctgtggaagtaggaagccaaacagtagatcacatatcactgacatcctatttcccaataggtttgctgaaaaatgaaaagcagatttgttgttggtaattgcaaatgccctaattttcaataatgtaaaaattagaacttgtatatattcatatttatcgtgacaaacacactctgcagaaaagaatgttgtttagttcaattaattggtttggtactgggaatggccctaagaataaactccagggtgagttctacctggaagctggaacagagagtcaagttaaagtaactgtaagtaagatgctgtagatgccttaggaatatattataaaaaaaaaatcaaaccaaaaattaaagagttaatatttccagtcattaaaatggaaaaagagactcagtaattctaaagaaagcagaaattagcaataggtaaaaatagaaattggtgaaatacaaaaacaaagaaaagggaggactgacagaactaaattctcattgtttgaacacagtaattaaaatcctaaacttccagtgagtctgatcacaaaaaagagggaaaagggacacataaacatcataaagaaagaaaagggtggccggggccgggcgcagtggctcacgcctgtaatcccagcactttgggaggccgaggtgggcggatcacgaggtcaggatattgagaccattctggctaacacagtgaaaccccatctctactaaaaatacaaaaaattagctgggcatggtggcagatgcctgtagtcccagctacttgggaggctgaggcaggagaatggcgtgaacccagaggcaaagcttgcagtgagccgagatcccgctactgcactctagcccggacgacagagcgagactccatctctaaataaataaataaaagaaagggaagggaagggaaggggaggggaggagaggtgaggggagggaagggcccggtggctcacgcctgtaatcccagcatttggggaggtggaggcgagttcctgtcactgcactccagcctggatgacagagcatgactcaatctccaaaaaaaaaaaaaaaaaaaaaaaaaaaaagagggaaaaaaaggaggacagagctatagataatttacaaatttttaaatactaaaagaataaaagtttatgtctataaatttcaaaaatgagagggcactgataactttctagaaaatataaactattggaagtgacaaagatttgaaaatggtaatgacaaatcagaaaaaagctcggacataagtagggaaatctgctatgagacagaggcagtatttcacatcaggagagaaaggttgggactagccaataaacagtgttgggacaactatgcatccatgtagaataacaagattagatcgccactttacaacaaacagaaaaatccatttcagatgagttaaagacgtaaatgtgaaaaagtaaatctgttagatatatttattaccttgagtcagaatattttttgaacatgacacaaaaaagcaataatcataaaggaaatctaatactgtatatttgactacactaaaattaggcttttgttcagtcaaaaaacaaacatcataatgaggtagataggctagtcccagactgtgaaactatttttttcaatgcatttaactgacaaggaattagtaaacaaatgtgcataccttattgagaacaatgatataatagggaaaaaaggaaattaactggcaatttatagaagatgaaacatatggagaataaggataagaaagatgttcagccctactaggcaccagtggggggaaaaacaaatttaacaataagatactattttataacccttcagattgtccaaatgtaagcctctgaaaatacaaatattggcaaggatatgtagaagaggtaaatcttagttatgctggtagaaatataaactgggacaatcactggagacaaatggtgatatgtggcaaagttggtgggctttgttttgttttttgctatttaattcagcaattggatgttaaggcaaatttctggagaatttctatcttaggtaaataaagaggtatgtatgagttggagcactgcttgaaattggaaataattaaaaaccactcagaagctcattaacttaaaaatggattaataaattgggggttattgattcaatggaatatttaagacagtggtccccaaccgttttggccaagatgaaactgttccacctcagatcataaggcattagattctcataaagagtgcaccacctagatccctcacatacacagtttacgataggttttgcactcctatgagaatctaacgcctccactgatctgacaggaggcagagctcaggccataatgatctcttgtccgctgctcacctcctgctgtgcagcccagttcttaacaggccagagaccagtaatgatctgtggcccagggttggggacccctgatttagacaacatgtttcaacacggattatttgtttttagagacagcatgttagcatgttgccatgttgccaggctggacttgaactcctgggctcaagaaactctcctgcttcagcctcctgagtagctaggacaacaggcacaagccaccacgcatggctggataatttatttaaaaaaaaagaaacataatcttgaacaaaagaaaaaatcatgttgaagaatgataccagttatgtagattatgataccaatttatgtaaagtttgaaaacatgaaaacctatgccataaactatttaacatatatgcacatgtaggtgtaaaacctttcatggagataatatatacctaaattacgttgcttttgtcatctgttatgggaggtgggaggatggaaatggggaagaagatagagtagacttcaactgcaatgtttcatgtccttattctgaagtatgcatgacagaagagtagaatttaacagatgtttgttcattgttgtttttctgtactttcttcatttcatatctaaaaagcaaagttcagctgggtgcagtggctcatgcctgtaatctcagcattttgggaagccaaggcgggcagatcacttgagcttaggcgtttgagatcagcctgggcaacatcacaaaaccccatctctacaaaaaatatacaaattagccatcggtgtggtggtgtgtacttgtagtctctgctacttgggaagctgacacaggaggatcacctgagcctggtagttcgaggctgtagtgagccatgattgtgccactgcattccagcctgcacaacagagtgagatcctgtctcaaaatttttaaaaaattttaaaaagtaaaataaaaataaataagaagcaaagtttactagtacctccatagcaaatatattttccatacccaatcataaaaagcatttaaccatttctgcagtcatcaatgagaaaagaaatccctatctataaatacgatgtcttttctggtcacatcttgcaaccaaaccccagaccattaggttgggtagaaaaatgcacagatgctagcctcccttagattgccaatatgtgtgtgtagtacatattggtattggtactaactgattagttactgaaaaaaaaaaaaatttacattcttctctattatgtttttacttattatgccattccctcaaaatgtggcattctggtattcagcaaaaatactattggttttgattaatgccaagaggaaatctatcattcatgcactcatgctttcatacacatttaattatgtattatttttccaatgttctagagactctggttaagaaatctaccccagcatttcctaataagttgggtgtaaatataacaaacagcagaaaataatccagtactgtattagtccattctcatgctgcaaatggagacatacctgagaatgggtaatttataaaggaaagaggtttaactgactaacagttcagaatggctggggaggccccaggaaacttacaatcacgttggaagcggaagcaaacatgtccttcttcgcatggcagtgtcgaggagaagaatgagcaaagggcgggaaaagtcccttataaaaccatcagatctcatgagacctcattcactatcatgagaacagcacggaggtaatctcctctatgattcaattatctcccactggttccctctcataacacgtggggattaggggaactacaattcaagatgagatttggaaggggacacagccaaaccactgttaaagtactttaaagtactttaaggctcaaatgaatacaatgcttgccacgtgaaattttcaacgtagatcttcaaatatgaaatatgaaattcagttagtcaactctactaaattttttttaactgcagagttacaaagggagaaaaaggggaagagtagacagatgcttgaagatagatggaaacaaatttattatatatttaactttataaaaagaacaggaaattgtgaggctctgcagtctcctgggtcagtttcctgatgccctggttctgtcaaggtttaatcactaaactacaccaactatagtcactactttgtttttaagccactttgagattttcgctatggactggaaagtctgggatatgaatgcctaagcatgaagaaaggctggacaccataaaaatgtgtaagaattggtgggatttaatttcatttgggtcacattaatggccatgaacatgacaactctgtaccataccaaccaccatacattgcaaagtagtcctaactctatatgtaggtaagtcagatttcttagtatcctttacttgctcagatgaaatgtatttatttatatattctggtaaaactatatgaatgtctgccatgtgtgaaagttatttttctgagtgaaatttacaattgcattgaaaaaatgcttgcattttgccaggcacttctgatttctctgcctgtactatttcattacaccttttaaaagctctatgaggtagactatgttcttatgttagagatcaaaacattgttatggagtcagtcatctcataaatccacttgtcctctctctgccatgattgtgccatcagtcaaagattaaaattttattataaccaattaaactcataaacaatttgtggatttaacaataggcattacttttaaaaaataatttataggccaggagcagtggctcacacctgtaatcccaggactttgggtaactgaggtgggcagataacaaggtcaggagatagagaccagcctggccaacatggtgaaaccccatctctattaaaaatacaaaaattagctaggcgtggcggcgtgtgcctgtaatcccagctacttcggaggttgaggcaggagaattgctagaacccgggaggtggaagttgcggtgagctgagattgcaccaatgcactccagcctggtgacagagctagattctgtctcaaaaaataataataatttataatatcttgtgtattataaatagactctataaccagcattgattcttctgtattaagtcttcaccagctcatatttcttcccttcttcaccatagcagtgtcagcctctaccactcattccacattggaatctttcattgttctttgtgttgtccttatttcatccacttctgctaggctgggatcaaaggcaattatcaaaaaaagggaacctaacaggctgacttggttaaatcattccattttaaatattcaaaagttgaggcccccacaacacagtatgacttttcatatgggtaaatcaagatgagaatccatacctctagctctgcctcactacaacaagctgcctaccctcctacccccagtcactgtctatgcctttggttttctattgctacccacacatttgccaacggcattgctagaccaagtatgttcttaaatattttatattaatactagattttaaaatataaagtggtaaataataaagtcagcgaggttatcttgctctaactcctcacttaataaagaaactgaagccggctgggcgccgtggctcaggcctgtaatcccagcactttgggagactgaggtgggcggaccatgaggtcggaagattgagaccatcctgactaacacggtgaaacccagtctctactaaaaatacaaaaaattatgcgggcatggtggtggcgggtgcctgtagtcccagctactcgggaggctgaggcaggagaatggtgtgagtccaggaggcagagcttgcagtgagccgagatcacaccactgcactccagcctgggcgacagagcgagactccatctaaaaaaacaaacaaacgaacacaaaaagaacggaagcctagaaatattaagagaccagggttacactttttatttttatttattcaactacttacaaataataaaaatctgcagaggcactagtgacatgttatgacaactggtttgatcattatttagattttggatttatttagattttatattttaataattttgttcacctctgtaacagtacaaaaatcagcagcttttacagtaatgcaaggtttcttctaatttcactgaccttttcctaatacttcaaaagaaaagaataaatacatattggcttctgccaccgttgtagttaaacaaacttgtagaattcgaaaatatttaatcaaaatgttttgagtaaaatgagtaaaatataaccttctatataatattccttaaagtttcctaatcacataaaatggaaagctgaatttggaaaaaaatcaaattaagttcaacagactaaaagttctcttatatcccaaaaggaaaataaagatatgcttaggtatgaaatatctgacctcaacggccttggaaagctgtacatggtccttacagccaagtaacaaagaaatttgaaacatgtgttacaagaaaggaaagaggaaaacacttagtaggaaaggacaaaacttaaagatccataaatataaatcccgactgtggcaaataattttctgaatgtctgtttccactgaccagatgaaaatcgtaaatcctcaaagatgccaacaagtacttgaaataatcaagtcacgagaattaaggagtaaataatagctctgtgcatctcaggctaagaagccaagagccttcaacaatctaccagccaatgggcaattctcctcagaacacatgcagctcccccgtgacaattttaggtaaacctgatctttgcctatatggtgtaattggttttaatttaaggattttgttttactctgtgacttctacccatgagagcgaaagccagcaaagctaggctaatctgcattctgaaatttcattctgtgtttttattttcctttggagggttcttgttacagaagagcttcattaacttaattaggcatgatccagtgggcccatacaaattaggctagccacagtatctttagaatggacaaaaataagaagccagctgtagtctttatattttgaagaaaatcttaccagctgacatttctttgtgtcacagtcatattaagcttatgacaactgcaataaccaaaatgtgttttggaagttcaagtctccaacactatgaaatataaaagacacaacagtggatagggaatgaactgttttttttaaaccacaattctttttgtaggcatctagctctttgctttattatagaaagaataatcctttggtaaaagtgtgcttataaatcaatttataactactagcaatgtgataactgtatcagaaaacatttaggagaaaagatattttcattttcttcctagaactcacaggcatgtgtacacctgtgcatacacgtaccaagataatataatacaagataatacatgtatcagataatgcaaagaaaaccagacactacttgacctgcaatcttaggaagttattgattttgcctcaatttcttcatcaaccagcagaaataagaataaccctcattcttcttcagagaaatctttaggcaacttccctgtttcaaaaggataatctggataattgttaaaatagagattcttggaccatatttcagacatcctgaatcaggctttccaccgaagagccaaggaatttgtatttaataaaagttattcttagtgggtcactataaactaaaatataaataatgtgaaatccctatagattcttactgggttattataaactaaaaataaataggaaagctctatagaaaattttgagtgatatataagtatataccatcaacattattcagaatttctagcgcaaaggaaaatgttgcaaagaaagtattcttacaggaatttattctggctaacctttacactatgaagagttgctgtgctgatcaaatcaatcaacccaccaaccaaacaagcatcttcaggaagctcaacatatacccttctgcttctcagataagtacaaattttaaccgataaacactaaaagtcacatctcatacaataacatttaatgtagcaaaatactctagatatggttctcgtaagtcctggaattctggaactaaatcataaacaattaagcataatcacagcgactttctgacttgtcgcttgattctttataaatgtattctcaagaaatacaataagaaaacatggaagaaaaaatatgaaaaccttccaacctaattctaattatctgaattaaccatgttgaaaacaagatactacttggagtaggaattcactgtcaccataagctatttgtgacttaaaaactagaacatggagttcagaacacaatccaatttctgtagatgacagtgagttcccagcaggggttgttcctctccagaaacctgtcttggatagtatcctggtacttggttgcgttggcacgtctgccacctcagaaatcaacaaagtcatgcttccgtttgaatgagaaacttgacacattcctctgattcctgaactgtgcctacacaacctgttataatgttttgtagattgcagtgaatactgctgaagtctcacagtggctacgttcaatttcaaacgtatatttgcaaatttggaaaatgtaaattaggaaattttctggaagaaaattatgctggaaataacagaaattgcttgcgttcacttggtcaactaataatgactgaacctcggtaacaaagatttctggggttatgaacgtcggtttttgcaatgttcacgaggttccaaggattatgacctaggccatacttaagggtacatagatattatatctatacaatctgtatagatatagtacagtcataatatgagctggaattgattttattaaagctgataatagaaaccagatggtccaagtatctgaatcaaatatagacttccttaagctagggttgaaaatagctcaagaaaaaatgaatgaagttctaaatatgacataagagctctgcggaggtaatataagtgtggatatccaagaataataatgacttgttctgaactaagttaattacgtcttccaaggtattttatttggagaacgctgcatggttgtgtgctatatcctaaaattcaagtgtgcagaagacttatcagagggtgggtagaaagttgcaaccaatcaagttttacatgccttagtctctttcacttatgggtgataggattatcaagtttcctgtccttctcttcctagagattatatttttacatttgaagcctgtagctactttcccatcttgcaacccaaaaaccaaaaagacactgtgttcactaactggcactaggtatgaacagaatggatgttttcaaacaaatgaatgactcaaaggaattcttaaaatgtttctttggtgtgaagagcaggggtcacaaaggcatatggatagtaaatatagaaatactagggatttgcatgcaagtttaaccagctacaaaccaaacagaatagttctgtctaaaattaaggtaggtaattagtttcctactgctgttataattagctgtcacaaactcgatggcttaaaacaaaaacatttattatttttcagttctggaggtcagaagtcccatatgagtttcactgggttagactgaggtgtcagcaggactgatgttagcagtcctttatggaggctataggggagaatcttccttcttgcattttccagtttctagaggctgcccacattccttggcttgtgatcctttttcatcttcagagccagcaaaggccagctgagtctttctcattttgcataattctgacactgactcctctgcctccaatttaaagacccttattattacattaggctcacctggataacccagaataatctccctcacttaaggacaaatgaatagtaacatcaactgcatctgcaaccttaatttccctttgccttgtagggtaacatagtcatcacaaggttccaaagaataggaactagtcgtgatttggagtgggatggtcagggccattatttggtctacccacaaccaagaataatgaaaatcatattttgctcctgcctgtgaatggtgaaaacttcaaaggaagacacatctgacactcttctgttgggagagtttattcaacttcattttgacttcactgacttctatacactgatccaaggtgtttttttattggcaggttggatttaattttcaaaagataaactgcttgattgcaatcaaaatcaaacagaataatttatgaaaaatggaagcaagaggagaaagaatgtaggaggaggtggacattttccaagtgatttaattgaatattatcttaagaatttctgaagctcaaattcagaaggacacgtctagttggctaaattaccaagtctgagagtaatgaaagagttgccattccatgagcctagagagcaaaccaaactagaaatagcaatctcacttatatatcacagaatttcagtttaagcataggatacaagactaaatcaagctttaaatgtgaactctgtattcactatgtaaaccttctaacggaatagccttcagtgtaaagagctagttggccataaataagtttaattcccttcctttaaatttagatttgactcaagctgcatgaatttctggacagagaaaaaataaatttggggcagctagctgttggttttacagaattaattccagtccagccttgtaatcgcatatatttattaaaataactttgaaataaaatgtacggggtcaaaaagtatcaaaatatggtgactttaacatggaaatttaaattttaaaagaactatgtggaaaaattaaaaataagacatattgacaatacacttaatcagacagatttgtcttgatactaaaccctttcagctaaactcaatgccctccttctagctcttcttaaagtttcactcttcaaacaactactcagactcaaagtacacccccaaattcaacccactcacacaaacctgacttgatcatgtaaaatatcctttccgctttagctgactaaactttaaaaccaatctaagcacctggtgtgtcagtgataatgaacaatagtgcatatggcctatagggagttagagttgactcctaagtgagtaactgcttgccactgacatacaaggacttgaatagctctgggaacgtgcacagctctttacttgcagagtagaaattccaaggattctacatctttcattttgattacagtcgacaccaaaggcattcacacttgagatactgactgtcctgattctacagttctttaaagtgtctcaccaaaataataagcaggcttcctgatgtcttttctttattcacatgacaaaggttgaatatcgtggttactgagtggcagatattgagataattggtgtctcgaagcacataagggttgctgtgcttgaagattttcactaaattagtgcttaaaagataacaaataattgtaatataacatgctgcgtgttaatgcagctattacataatatagactcaacgagaagataactaactttactgaacgaagtcaaagacaggtggtagcacctaagttgaatcgtgaaggataggtagaggtttgacagaaagaatcaagaaggacaatataaacaaatatgaaagcaatttccaacagacataaataagggcagtacatttgggaagctcaggatgtttttatgtggctggtatgaaaggaagaaataggggaacagcaaaagacaaggctggaaaggatggctgaggagaaactaggaagagcttacttactgtcactgatgaggacttctttggaaagtcatattctcagaagtgttaggaaatcataaaagaaacaaaattttcaactgaaagcatttgattgaaaaaagaccttgcttgagggcgtttatctttatctttgtgaggtcaaattttgctaaggatggttaagatggtaaagtcagcacctgatacagaagatgcttgactacaaattcataatatatctatggtctccctggaccattcagttttaatgcctacagaaccagtgtggaacaaaaggtacgtagacctggtgaaaggtcacacttgtttattgtaagcttgcctttgttgttgctatttctaatttcaagtaagaaacaagtttccagacctcaaataaggagatataactggtagatataactagtagatcttctcaaaatgacattaacttctttttgtaaactcctacttcctcatagtatagctggagaaacatcttaccaatgtggagtagacagtgatatcttaatagcagaaatgtctcacaatttgattctttattggtgtgaaacactgtatcataaaaggtttcgaggccatatccttaagaggagtggtagattttcaatgaaagagctgtttagtattttggaaaatgcaacttctaaaaccagcaaacaagtatcacaaatggtgatgatgatcatagcacccttggcaaatggcctccagagaaccatcatagctggtgaaatggatacaacatgattaaagagaacttccatcttttctttctgagcatttcattataccactgattctcaaagagctggccctgggaacctagtgaggtctttcccagtaggatacatatatatgcatatctcatatattcacatatagtagttatgcatatactactgatatgagtgatagggacttctctagatcccaagttaacttcctaatagtagaaaaggcactacattgatgtaatatataatgcccagtaatttccactaattctagtgtttgctttttttgctggattggtttgacatgtgaaatcacacagaataaatctaatctccaatctccactttacaatccccactccatgacactcaattactttaaatgttttatcctctactccaaagtctgctgttttttaaagacaaaaatcaaaccaaataaacataaatcctaattatctcacttttctataatagaaaacttacaaagaaatttcaaacaaatggaaaagtttactttatcaaagatctcctaagaatctgtaatcattctctaatattaaaatgtttggcacaaacatcagaactcaaatatataatataaatcctggcaaacaactccacaatatattgaaaaatccacctaatcatttgatacggtttggctgtgtccccatccaaatctcatcttgaattgtaatccccacatgtcgagggagggacctggtgggaggtgattggatcatgggggcagtttcccccatgctattctcatgatagtgagtcctcacaagatcatggttttatatgtgtttgactgttcctccttccgacgctctcgctctgtcttgcctgcggccatgtaaaacgtgcctgcttccctttctgccatgattctaagtttcctgggacctccccagccatgaagaactgtgagttgattaagcctcttttcttataaattacccagtcttgagtatttctttatagcagtatgagaatgaaatcatatatgtttaaccccttttttttttttttttttttgggacagagtctcactctgtcacccaggctggagtgcagtggcgcaaacttggctcactgtaagctccgcctcccaggttcactccattctcctgcctcagactcctgagtagctggaactacaggcccccaccatcatgcccagctaatttttttgtatttttagtagagacgtggtttctccgtgttagccaaaatggtctagatctcctgacctcatgatctgcccgcctcggcctcccaaagtgctgggattacaggtgtgagccaccacacccagcccctaaacctgttttttttttttttttatggcaaattaaataaaaaactttaagtcaaaatgtgtgaaaagattgcagacaaccaaactatggcagaagagtttgatcacatgataagcttactctgaaaaatagttttttaaaaaacaagaaggatcagccaggtgttgacatacaaaaccatatagccaatcaaagcttatttgaaccatatacctatgttgagagagacagtttagaatttaaatgccatacaggggcattcagtgcttagagggaaaaaaattagtactgcttttatctggatataagccatgagtggagaaaaacaatgtacacacatgtagactttatatatgtatgtatagtcacataatctttcatatatatgtaatataacaaaccaatgtctgggaaagttaatggcaacagtttaagagcatcaagataaactctttgtgcttagaaagtttagttttgtcttaatgctattcatgaagtgcatcgaaaagttagtttaattcaataaacactcttctttagaattatttactaagtttactgtattggaggtcataataatgaatcagaaggtgctcttgttttcactgagcttatagcctaattaataagaaaaagtaatgatgcgtaatccatgtgtgttgacttttaaaaattcctgctctatgtgtctctctttaaaggtgtaagttagtatgtcttcagtaggctagacacttatcttagttacccacaacagatgcaattctatgttgtgcctatgccattgtatatcgctacaaatcataggttaagttcctggaaggaaataacaggctgatcaaggattttcttaaaagcttcaatatgtcttaaaggcacaggtatcagagattctaaacatatttatctttttcacaaaagtaatatatcctatttgataaaactatagaattcatagtaatgcagggtaatgtgaggttcaccaatcattgtaagatataaaatacaagaaaaaataatatagtattttgcatatcatgaattatcttaatatgaaaataatactccatcacataaaatatatggattttatggattatatggattatatggatatatggattatatggataaatatacgcatttataatacagtctcaaaaataaattagcaagtggacaaatacaataattacttttaaagcactctggggaagatctgaaaaaaataaaaaagatgcttaatatactacattatttaaacaaatgtaaattacattgagttcatggttctatttatgaacttagaataagcatcgttaacacataaagaaaaaaacagacgacaagaggcctgcagaggagcagaaacaatgcggaaagtgagaaagaaaagtccagttattttgaaaaacaagactggtttcaatattatcatttggccatcttaaggaactgcaggttaatcaatacattataattgattaaaaggaagtatttacaatatatacaatagtactaatatatttagacacataaactacatttaataaaatctgtgttaagagtcctaaacaatgctataatatttaatccttatctaagctaggcaacacaaagcaacaatattgttgataaacagctttgctacataaggtattgggaaactaagtaaacttgtgatagctttggtttttaaggtgctatggttggactccatttgacacatttaataaatggtgcatacaatttttagctaaatatctaacaggatgtcatcctaaaacctcatgttcctatattactgtgctgttaacagaaacagcttgcagagatttatggcttctattaattacactaaaaaatatggtagatttgctcaaataaatcaattgtaacagaaaaaaagcgcatttttaaaattacaatcatgcgttacaaatgactgccattatcaattctgccttttcatttattcccaaagtgaagggttaaagggggaatctttctgttttcctagatttaaccctggaagagcagtctttgagttagtactttaaatagcttacagggattctagttaatagcctcaaaaattggaaagaaatgagacaaaatatcaagacaagaataagattgaaatatataaatttctgcctatccctgtttttataaagtaagtttcctccccttaccaattatgtttcagttctatatttccattcagtgctactttggctttttttaaaattattcatatacctgttaatacaccctccttgttccacaaagaatttaccaatctttgcatttatacaaacaataaaagcaaaaatatcaaaataaaacaaaaaaaaggagaaaatatttttacaacagtgaaaataaaaggaagaaggaaagatcaaataaaaaacagaatgcattcaagtttacatttagaactacatttcagatttctgaacactttttgttgggctctaaatcaatatcaatttcatgctcactgatgttcccaaggagttgtgtttctttattcaatatggccctgaacactgtgagccctagatgtaacttatattctcaaatacttatgtggcttggcattcatacagaatctgtctgaattggtaaaaatactcagatttgttttttcactcttcattaacctcctatgacaagtataatccactatcccaaatatttattattatttaaaagaaaaatgtactcatttttcttggaccaacttgtttaaagacacaaaggactcatcatcctgaagaaaattacaaatgtattaataactttttatgccatctataaacatctctcattttggtactaaagaagataggggtctttttatccccttactagttagagaagagccaaacatataaatatgcatggagaaaagcctgagagaacatctaccaacatgtttacagtatttatctgagtcactggatcatgattagactttcatacattctccaaattttctacaatgagattattgttcaaaaatagccagtgcactctgggaggccgaggagggcagatcacctgaggtcaggagtttgagaccagcctggccaacatggtgaaaccctgtctctattaaaaatatgaaaattagcccagtatggtggcatgctcctttggtcccaggtatcccagttactcgggaggctgaggcaggagaattgcttaaacccaggaggcagaggctgcagtgagccgagatcatgccactgcactccagcctaggcaacagaacaagactgtctcaaaaaaataaaataaataaataaataaataaacaaataaacccagcatctgaaaagtatcaaagtactgaaacaataaaggacatataatcagtcaatatgaaagcataatatttttgacccttagaaaacaggctaggaaaatggtctttctatcagatcatgccttttaacacaagcaattatttccaaaaaccaatcaaatgtacaatgctgcttatacttcatagcactaaaaagtatccttcatcatgaatgggagaggatctttcattggaagagccatttgtaaaggaaaccactgtctgaccttctcagagaaatgctgtcttccaacgagttaaaatgcttgggttatcaatctatgagccaagttggaatcattaatcccaagtctagacatttcaagacgtagaagcaaaatagcaaaagatacagagtgtatagagttctgctcctttgctggaaaaggagacaaaggttgaactttaactgaaaaatgatacggtttgtctgtgtccccatccaaatctcaccttgaattgtagctcccataattataacgtgtcctgggaaggacccggtgggagataactgaatcaagtgggcaggtctttcccaagctgttctcatgagacttaatacgtctcatgagatgtgatggttttatgaaggggagttctcctgcatacattctcttgcattccaccatgtaaaacatgactttacttctcatttgccttctaccatgattgtgagacctacccaaccatgtggaactgtgagtcagttaaacctctttcctttataaattactcagtctcaggtatgtctttattagcagcgtgggaacagactaaaacaaaaagtaaaaactgtctatggccatatctgtctatatcaccctgaatgcaccccatctcttctgaaaagtaaaaacaaaacaaaagtcattgaagcatcagttacctatggaacatcttgtgtttgcaaaactgatgcaaacaataactctggagtaatgaatttttttgatacttttttttcttaattcaaaagtagaaagttacaaaacacaaaattcacagaaaacaaaagggggaacgcaagatggatgagggctctactgatggccctttcccccacccgcccaccctttttttttttttttttttttttttttgaaacggagtttcactcttgttgcccaggctggagtgcaacggcgcgatcactgcaacctccgcctcctgggttgaagcgattctcctgcttcagcctccttgagtagctgggattacaggcgtgcgccaccacgcctggataattttgtacttttagtagagacggggcttctccatgttggtcaggctggtctcaaattccctacctcagatgatccaccagcctcggccccccaaattgctggaatttacaggcatgagccacggcgcctggccggcccctcccctttggtagaaaccaaaaatcaagtgagcactcgcagtgcctaattttgatttcatattgttgaaagaggcactgaagaaggtagaaaagacagtggtgaattgcccacgctgcccctcccccatcccctggctgcagcctggtagtgtaaggaatctatgtgcttgggatgggtggagcacagtgaatgggaggctttcatccaactcagtgctgccctctcacagtggaaagcagaaccaggctgtattcagccgacacctgcccatggagggggcatttggactggcctagccagacggaggggattgcccatcccagcagtcagagcttgagttcccacaagcctcaccatcacaggctgaagcactctgaggccgtatgtgaactccaggggcagtctaggccacaaatactgaaattcctaggcaagtcctagtgctgcactgggctcacggccagtggactggaggggcatgtaacctactaacactccagcctgggtagttaagggagtgcttggatcacccctccatcaacaccaggcagcaaagctcacagctctaaaagacaccctttccttctgcttgagaatagaagaggaaagagtaaagaggactctgtcttgcatcttggatgcccacacagccacagtaggatggggcactggtcaggtcatgaggtccccattataggccccaggtccctgatatttctagacacatctttggccagaagggaacctgctgccttgtagcaaaggacccagtccaggcagaatccagaccctactgactaaagagcccttagtccctaaagaaccagcagtaatacccaggtaatataccacaggccttgggtaagtctcaaacacatgctggtttcaggtgagaaccatcatattaccaactgtggtggctatggggagaaactgcttctgcttgagaaaagcagagggaaaaataaaaaagaaactttgtcttgcacctgaggtaccagctcagccatagtggggtaaagcaccaggcaggctctccgggtccccagcatcctggatggcatttctagacctgccctgggccaaagagctgatcgccttgaagggtgagtcccagtcctggcagccacaagctgactgaagagcttttaggccttaagtgaacactggcaggagcttggcagtactccctatgggcccgtggtggtggccatggtgtgatgttcctctatctgtggaaaggggaccgaagagtgagaagcactatgtcatatggctttattgccagcccagccacagcagactagaacaccaagtagacttctaaagtttttgactccagtccctggctcccagatggcatctctgaatctgccacaagcctggcagaactcaccacccttaaaagaaggcctggatggctttgccacctgcagactgtagagccctatggccttgagcaaacatagatagtagccaggtaatggttacagcaggccttgggcaagactcagtgctattcttgcttcagctatgacacagcatagtcccagtggtgatggccacagggttttttctatgacctcacccttggctccaggcagctcagcacacagagacagactccatttgtttgggagaaagtaaggcaagagaacaacagtttctgcctggtaatgcacagaacttttctggagcctatccaagaccaaaatggcaaaacatctacaagtctccaagaaccactgtgctattggggttgggatgctactgatggcagtattgtttttcctactgattgacagtgttgtcacagagtaaattcttaaacgaatagcatagaattcaaatgatcaaaagcacatattatcagggttggaaaaggaaaattagaaaaccatacatttattaatttagtcagttaagaaatatgtatcaagcacctagtcattgtgccagattggggaatctaggtacaaaaggtacacaaccagcctggaatggacctccagtatggagatgaaaataattataggtagtgacaatggtgacccaatgtagtgcactgcaaggacagaaaagggtagaagatatcagatctccatctctacactcagtcacttacacttagcaatgtgctaccaaacagaagatgaaaaggagggaaaaatggaacatgacaggaactccctctgcatatatttacaggcacaatgtccaataaactggtgaaagaaaagtgtttctataaacgaccttagcattctatctttcacctgagccaatagttctaaatagaaaactgtgaacatgttttcacaattaaggtgtttacaattacatctatctgtaaagacccctagatattgctggcatacaccttcctcattgcccagggcttctgagacttcacactaccttgtctgtataagcctttggtggtgcttcttctctccacttataaataggatgacaacagcaactgtgactcttgccacatgatataaacttactatgagccttatcaggaatgagaataccagagaccattgtttcatgagatgatgaattccctaaacgtgtaaaaagacaatatacaaacaaatatttaatttttaaaattgtttttcaaaactgcagcaggaatcagcatgtttttatctgacataaaaccaaaacggccttcaacatctctttgtaatagtctcatgtgctcagacactacagacaatcgtcaatagaaaagactgtcaacttgaatgaactcaacctgcatcaatatttttccagagtcagcaccatgcccaaactaagagaaacatgcagttacataaataaatgaatatggatgcatgtgcatatatatgcatttgtatatacacaaaatgaatgtgaatatctttctatatctgtatcctagctttaattccatctccatctctatgcacctgcatatactcattcaactaattcattcatctgcataaactcattcgatataatcccctttagtcaaacccaccactgaattagtcttccttagactgctgccactggaagatgaagagattccaacaacactgcaaaaaaatatagcaactaaacctgtcttaatcaatttttaggtttcaaacagaggttcttaatcataagtagtattctattacctgcaagatgatttgtattcatggaagtatactataatccttaccagaaactaataatgattttaataaacttgcattgacttcagaggtttcaccatttataagttgcttaattcagtctttgtaaaatcattcattactctttacagacatcagctggggaactacaaggcaattattagattaaactggatttaaaggttgcttttattgtaattgcaaaagaaaaaaatctaagttttcttaaatattatattgtacttagacaacagtttaaactcttggtgtgagtagaaaggctgggtctttggccctatagacagctttctccagtcagtggtttcaaaagtatttactttgtaacactggagctacatctccttaacggtttgctttctcacttatttgagaacttttttcctataacgtgaataaaaagaagaaccttagcaccccaagcaccattttttaagttaaatacttcctttatatgagaagcagatgctgtcaatagaagtcacccgaattcagcaagcagttagacgattaatcaacttagaatataaatccaactatagttgttacttataagggaagttgatgaaaagtacatgtcctaactctcctatccattgatataatcaatctatcaataataaagtattaattagaaatattttcaggactttggaggaaacaaacaattatacattgcttccacatgcaaatatttcacaatttagttatagtgaaatcccttaatggaaaagcccaactaattagaagaaaggctacaatgaaaacatgtactttgtattaaaaagcattagacactataatgtgtttcctatcaaccatgcctcaaagtttctcctacctgtcctggaaacacaatatagctattctcacaactacatatatccaaaattaaacaattatgctgagagtgtttaattcttcacttcagcttccagcatatcatactgtcaatgaattaacattcattgacaatctactatgtgcccagtactgttgttgtaaagtaaggaactcaaaaacaagacatagtctctaacctcaagatcctcccaggagaggaggggagacccatgcatgaagtaaaacacaatgctttaaggtatagtcgaggaaagagcaaagtgccacagtggcacacaagagaggaccattagatctcagaaaatagccagggaagtaatatatgagctagatctttttcagaggaatagatttcccagtaaacattaactggatgaatcacagatagggtgggaaaggaagaagacttactaaggcagagaaatacaagcacagcatgatattttttgagtggaaagttcagcctgacaagagcatgaagtacattacatcagataagggtaagtccaagatgaggccagcaagggaccctggccatactgcctcagggttttctcctatagccactggggaatgataccaaagtggacagtcaaggaacagatgccaaaacccttgcaaaaatccccaaagcaataagggggactcaagctaaatcagataaatatagcatgaaaagaggaggtcaaatttaagatgcatttctgaagtaatcaattatctcctaagctattgcctactgagtttggtggaataaggaggaaaagagaaatcaagtaagtctgtgagttttcaggctttcataaacgggtatgatgatgccattaactgagatggaaaatatagaaaatgggagagaaaataaggtcatcccttaacatgtatagcctgagattactgcaatacatttaggtgcaaatatccagtgaggaggtatgggaaagtaagcaagttattttccatgcaacttatttaggaacaatagcaatttgatttctgggttttccatttatttaagtaacaaaacaaaaataaactgccatcttttaatctattagttgaatcactcttggtaacctctggcctatcaaactgtgcaactgcccatgctcccaacccaactgccacaaataaactcttcttctatcaacctcttcagcaagaaagcattttgccaacataatatgcctcagcagaccttaaaataatgaagttggaaaaatgtgggtgagcaaattttgaagtatattaaacctgacaatttaatatttatgtaagctgcaagtgctaagcataattggacttaactattggcttaggtttaatgggttgtgaatttaacttcattatcatagttttgcctgctctttgagctcattcaaccgaactagagaaaaaaaactgagagccattttctacctcaccaaaaccatttttgagatgacctgaaaccattgggtcaaagaaggcggattctttcatttcacaaaagagaagagcttcagtgaagactcctcagtggttacagtcagaaaacaaacatgggtttactctagatgggctagttactgtgagtctttaggcaagttactaagcctctggaagcctccatctctacataaatagggataatataaaactttcaagatactgtgaggatgaaaggagaatgtacctaaatcacctggcagaatgcttttgcacatgatgtgacatcagtgcacgttggttcccttcagcactcatgccattaccttgtgcttcaacagacttacaccacttccaggcctttctgctcatctctatggaagttggcaacataagcatactctacttactagggattgatcatcctaccagctattacagccacctctctgatacgatttgtagcatgtaaatcagaagcacaggtgtgccacagcatggatgagtcctttgggtttttttgtttttgtttttatttttcggggagcgggggtgtcgaggggtggggatgtacatcgtatactatatcatcctaaagaacctaaactaaaaggatccttatttcattccattttatgctttataagcacaaaacaatgaatggatctacatacaattgtggacaaaatctctctgaaggcatgtctccaggaattcctttgtggaatgtagtgatgaggaaaggaggaaggaggttccaagggaaggaaaagaaaggagggaaaagtgtccaaataactgtctttacatgcattcacaaacacacacacacaccccctcacagtagccaataggcatgattctacaattagagaatgctaatgtaatgccagtatgccttgaggaagatcacagtctagtcctttcatgtggggaagaaaagccaagagaaggaaaatcaattacctgtgaatagcatcttacaggggcctctcaacctaacaaatgaagagacatgaagcatatgcagagacatacgtttcctatgtgcaagcatcaagaatccagaccatatgatgtataaaagagatgaaataagttttcaatttatttccagggagtaaataagtaactgttgaaggagggaaaccaaccccagatgctatttagggcaccaagctttacttcactacatgatgcttgatattctgaaatccattctgcctttctccctttctcctaaacacctccaccccttctgcacatgaaaacaatgctaaacagtcttttcatattttgtttatattttatgctagaggaaggtcatttttatatctatacaataatctctctcacctccttagttgccacattttaagttacagaaactttattcaaaatgttcacaaagcacattgcttaaattataaatgaatccaggatctgtcacagttttttttgtgtgaccaaatttgggcatctctctctgtagaagcaggacaatagtcttaggtaaagaaaaccttacttgaatgcttaacttcaacagaagcccaatgggggctggagcagacacataaatcaatggtagaatgctgactacctggggctgcagggtttggaatagttgggaagacattggacaaaggatacaaaattttggttaggagaaacaagttcaagagatctattgtagaacatggtgagtatagttaatattatattcttgaaaaatgctaagagggcggatataaagaattctcaccacaaaaaatataactaggtgagttaatgcatatgtaaattagctaggtttagtcattccacagtgtatatatacttaaaaacatcatgtacatggtaagtatctacaattttgtctattaaaatctgtaagcatataaacagcaaattaaaaaattcataaaataagtaggaatagggccgggtgcggtgccgcatgcctgtaatcccaacactttgggaggctgaggtgggtggatcacaaggtcaggagtttgagatcagtctggtcaacatggtgaaaccccgtctctacaaaaaatacaaaaattagctgatcgtggtgacacgcgcctgtaataccagctgctcaggaggctgaggcaggagaattgcttgagcccgggagggagaagttgcactgagccaagactgcgccactgcactccagcctgggagactgagcgagattctgtctcggaaaaaaaattaaaaaataaattaattaattaaaaacgaatgggagtggcccctggttataatgccatttgcaatggagaatgaccatctcctactagagctgccatgccaaacctcgtggagattcatagaatagtcacttaataaataaacacaaatatttattttattacagtttattgcaaatctaggatatataattttaaggcaacctagcaataagtttaagggatgtttttacattatggtggactttataggaaacaaatattattcttgtgtcacatgtttacatgtcaaatataactctattcaagttaacatggaggctgcctgccacacttgggctgcaaacatctgtgattacaggatgtcagcttttacgacgcactgcattctaatccgataacccagtacactgtttttccattattcaattccgcatatagctgagaataggacacagtatttctaaacctttttttttttaatctagacttctgtataggatatatctatacattacatattgaattgaagatattactgttaccctattaacccggataatacaaatagttgaactaattcaagttccaaagtaaaatttcatgacttggatgatccagttcagctgtcatgaaatagggatgaaaaacggcacattataaaattttagtaaagtattttgcttatactacaaaagggccagcatatggtattcctaataaagagattagataggaagaacgagaggtatttccaaactctagaatgccacttagcaaagcatcactgtggtatattttagcgctccctgttcacccagcagagcgctcaaatctaaagcaactggtatattccaagagagtcacttagaaccactcagagactctcagtgtctctcccatatcttcttatggcttgacccatcccctgctccagggcagcagggaatctgaatctgaattaactgtccacatatatcaaatcagccagaatactggaaaatcacggcgtttagtacatgaatagcagttgccattagagtactgacggcaaatggatgatgtaaacagaactttgaaaatgcaccgaaaaaaataaaaaaggaagaatagaagtactcctttaattttcttaattctggaggggtttatggaaatttctcttcagggatcttcatgaatcgggccatatgtactttatctctacaattgggaaaggataagtggcccaaagagagtgaatcagcacaagtcaagtggttgaggcattttgcagagtgatgagactcagacaggacttcgcaaagaagcaaccaggtgaaaaacaggcttctcagtgtttcccacatatcacctctataattcagaggaccagagtcatctgtgggcaaagtgcagcacaaccatcaacaaaaacaaaattctcacatcttgtctcatcttaaaagtgaatgagaattttacgtttgtctcctcaatgaatgtaattttaatattaaataatccttgttttccttcaatctctgagaaaagctgatattccgggaagatgagacatattaactttatcatttcacatatgcttggctgcatcccaggacttgagtgtgttcacgtggcagcactggacagggtgtttaggaggtaactccataaagggcagcagcacagagcataggaaggatatgggatgtgaagtcagtttcttcaaggtcaggctctgtttcatgttttgtggttttgtcatcttttcttacctttattttagattgatgagttgtgaaaagcattgcccttatgatagaagtatcatgaaaataaactaaattaatatgtgacaagtatgtaactggatgcctgaatcaggtggatgtgcattccacggaagcttgtgttaccatgtgaagatctctgctcatccatacacaaaaaccacagaacaggagcaatttagcaccactcataaaacagggcacttaaagagtaaaattaaataaaaattataaatcaacacaaaatccacatttgaacatcactatttaactcaagtttatttttactaatagctggttataggtactaaattaccctgcaataaatgatttgctcataattcataaaaatggaagggatacttgagtattttgaggttttcccttaatcatttgactttttccttccttttaaccgtattttttccttatacaaataatataaaggagaaaaaattcagtatatttcctacattaaaaactccaacataaatgttgaataagacaagattagattcatattaagttctgattacgagctgagctactaaggctcactgtagctcaggctccctattagtaaagtgggagaactaattttctacctatccctcaggactgatatcgagattaaatgggctaacctgtagactaaagtggtttaagagtagcacacattttaagtattttggcatagcagcacactttttgttaagtgatctttatcatcatcattattatttgttgttgtgcaaacactgctctttctgaactgcagtgcacccatctatttcaaagagataatacttcacaggattgctgtgaaaagtaaaacacatatatatattttttgtaaagcacttagcatactgttcggcacatattaaatactcaataaatggtggctattatcaatttcagtattcagaggaaaaaatctgaggcactggaaagcctagggtttttgttcaacattacattgctagttagtgtcgattctgggatgggatcctagtttttctggtgcccagcccagtgtcccagccacaccacatggtctcctatagatacctgaatccaaactaaaaaccaagggctgatgcttctttcctctctgttagacaaatgaaaacttaaaccattctatttgaacagcaaaaaagctgcgaaagtcaaggagtgggcatgctaagcaccacagactgacctttaaagtatttactcataaatattcagttcaatagccaaatgccagtcttggtgcaccactgtggtttcattcactgtttgaagttacagggacattatttcatccagtctagttctgctgtgttattctacttagtttttagaagagctttaatttcctggcactttttattttccatataatcatttcattaaaccatacaacaggacgtgatctggtttagatgaaagggcaacaacaagccccagaaaaataactttactagccagctgctaacatgctgaaagtaagtttttctaagcctagctaattacattaacattttccacatcaacaaccattatggttttatattttcatgttgaaatattatatggtcctccatctaaatttatggtttattcttttcataaatactaggatactcaaaacacgtgatgaaaaaataacatatccaaaagattacatttcttataatcactaaaatagatgtaattccttacttttcacaactgagaatgtttttcttaatggtatcccctgtaaagtaagaaaataaccaaaaagctgattgttcatttgttaaacaagaatatcaaagttaaatgagcctgactctgttctaatcagaggatatatatttttttaactatcacaaatattggtaggacttgccagttgggcaaagctatccttatgatgacgtcactaaaagatgaggaaaatggaagtgaccaaccagaacatggggtaaaggatggaaagaaaggggaataaaaaccagagcagggccaggcgtagtggctcacacctgtaatcccagcactttggaagcctgaggaaggtgaattgcttgagcccaggagttcgagaccagcctgggcaacatgacaaaaccctgtctctacaaaaaatacaaaaattagcagggcatggtggtgtgcacctgtattcccagctactggcaggggtcaggtgggaggaccacctgagcctggaaggtctgggctgcaatgacctgtgtgtgatccagccactgcactccagcctgagtgacagggcaagaccctgtcaaaagaaaaaaagaaaagacaaaagaaaaaagaaaagaaaagaaaagagaaaagaaaagaaaggaggggaggggaggggaggggagagaaaagaaaaaagaggagaggagaagagaggaggagaaggaaagagagcaggaatagcattcattatcacttccagaaagatgatgtttcaatgttaactactcctttttgtacctaaatatcaagaccttgtgaaaagaaaagaaaagaaaagagaaaacaaaagaaaacaaaagaggggaggggaggggaggggagggtttgggaggggagggaaagagagcaggaatagcattcattataacttccagaaagacgatgtttcaatgttaactactcctttttgtacctaaatatcaagaccttgtgaaaagaaaagaaaacaaaacaaaacaaaacaaaacaaaaggaaaggaagcaggaatagcattcattataacttccagaaagatgatatttcaatgttaactactcctttttatacctaaatatcctacaaaacatatctcctttacacgattcatccagtaagtatatttatatttcatattccattgtttgcttttgtatgtttggccatatcaattcaaaagcactgaaaaatgttcatttcatttaaaggccaagattaaatgtatgaatttgagtctataggcaaaggatacaactggcagctgtacctgaattaagtggaggtgtttgagtgaaactgtagatagatcatttgagaggctgtacaatggagaaaggaagctgttcaattaaggtgttagaagcaaatcggaaggtaaggaaaaacacaagggtcacttgtcagttattacatgggaatgcattggtcagaagaagcaagacagaagaataagttaatgaaaatccacatgcttcgaacttggacacagggagaaggatggcggtactattgactgaaataagaatgcagtgttttggagggatgttcactgaggtgagaagaggatgacaacttctgggggaccctgaggctggtgggaccacccacatacaagtggtacctgcctcaacttttctccagtagagaacaatgaagacatttcacattcttttttatgcaagactattagcatgttttaaacaattgcctctagagtgattatttaaaattataatcgattagtttaaatcatgatgtgttctgtgattgggtatggcattgttatgaactactaccgtgccttcagactgattaggtattaaaacttacaaaaaggaaaggattattaataacaccagtagttagtactttcatgtgtttatattcaacattctgtcaataacaaaaccctaacatttattcattagtaaaaaaagacttatattttacttatatttggtgtgcgtgctgggcaaagggtaggatgtcttagctctccattacttccaacacataacaggtattcaaagaatgttacttttgaatagactgaataacaaatataaaaaagcacatgtagattaagacaaagttactctgcaaatgttttaaaagagaaatggcattctttcatctcagtggcctcttccatttctagaagagagagcaggaaggggaagggaaaggtactatccctgacattaatgctaagggtgtaaacattataatatcttactttgccttccttctgggaaacagagcacttcaaccatatctagaaatacttgagagactattctgctactgacttattttttttaaaactaaaaataaatccaagtgggaataaagggcagattaaaatatcatagcatcacagactctctgacatcatcatgctgtgttttttacccaaagtttgaatctcctgcctctctagcacccccagaaaatgatcactcacctctacctcctaaaattgccctggtaattttcaggaagctgagatcattccagagttcttcctgggaccaatccaaaaatctgccactcgctgagcctgatttggctgtctgcatgaacacaaaatgagtctaatccctcttctacatgacagtccacagaggcaaccaccagtttcataactggtttagttgtttttcttacaccctgagggaccaggagaattacattttcacattctcagcccaactgtcttttctgcaagaactttcctaaatgaataaatagtctgtcattttagaactagctcttatcaaagaagagtatcgctattcttgcagttttttttttttctataaaatagtaaagttgtgtccttcacattatggtaagtctgggaggctattagtgagaatatgagtttctctagttttgttctgttatttgatatagtgttatttttaatatactgtcattcagatgtgaatatgacatgattaatacattattggtaaatgtcatttaagatatgcttccaggagaagcaatggtattacactgagctttttgaccctcattcttcatatttgtgaattcacctatttgctaaagtttatttgtaacctccaagtcaatacttatggtgatttcagccatttcatacagtggcaaaatatttgagttgcccaacacatgcagtcacagctaaggtcaaacaaggcaaccagtttatgcatttgtggcaaatgagactaatgagttcagaggtttgatcatcccatgaccaggtataggtttattcatagtaaaagacctccctgcctgtattcagtttgataagatgccacacagattaatgctgaatgttgtaaggaaggccaggataaatgagggtagactgaaatagagaagataatcacttaagtactctttaggactgagtcaatttcattttccttttatgtagagccctacaatgtagaatcctacagcttctcatatctttgcaaagataactactacaaaggagtttatgcaagaaataagagggcatataagggatctggcacattgggatcttggacctttagacatgagacaaaatgacaaaatgagacaaaagacatgagacacaagacaaaatgacagacatccggtcactttcaggaacaagtatctgttagccaaagtctacgacagagttggacaattacttagccctgactagtcctcatatttcacaaaaagtaatctacatatggcaagtaactccaccaaggaagagggcttcctattttcccactttctgaactaaatcagctcaagctacttttaaagaaaggagagcccactcttgagacttctttgctccttcttttgtttggcctgctaattctttctccatctgaggggtgagaaagacttctttttagctgtctctttcactgccaacctgctttgataatgttctgggggctttaccagaatgacattttagaccactctaactcagcttagccactgaagctgagcacagctgaagaaagcactcaattagcaactccaacttcaaaggctatattattctctcctcaatacacatgtgtaactcccattagcgttaatgggagctgtgggagcccacggctcagagaatatacctccaagtctgtttgcttgatgagcatgcaattaaaccttatggcccaaatttttcaaggagggcatagtaagtacaccaagcactcatgcaaaatcaagtgtgcttactttgagaaaaagtaagctatcgccactatttaaacatgaagaaagagcagtctaaattaggtctattttaatttcatttgtcctcttaggtgtggacaatggcctttcatggtgttttgaggaaagtcactcctcttttttaaaaggtgaattatatgtttttagaagcattagttcacattgcttaaaagactagctagcctcaagggtaaaaatgtctaataagaacaaaaccattctaagtgaatttcgtacacataaaatccagcatggcacctatatacactcagtggcttttcctgtctttatttaatagctgtattctaacttaaaattaggaaaaaaattgatttgacattaaaaagaaaaaaaaattttgagaggaaaatgcatgccccaataataaatttgtccttatcaggaagtaataatttccgtccctttcttgcattctaaagagatttgtccatatattttcaacatgaaatcaatatatatttcagcttcaatgaaatatcaatatatgtcagctagtctgtgctacagccacagtcttgaacaacatcttcatggggaaaataatcttgataatttagtaccatttaaaacaattccttttctattattcagacattttccccaaaatttaaaaagaaatttatgaatgaaagtttttacattttataaaggagagttagctaatcacttttaaagtcatacaagtgaattgttgatctactattgacacataattcactctaccaccaaacctcatatcctgactttctaaccacatgaggcttttttaggtactggaccatcagtacaaatcaattgaagtgcaacgggccaatgaacttatcagaaagacaaaagcgtccacactaagcttatgggaatgtcgagatgtcaggagacttttcaagttgtaacatggcagatgagctagaggaaaactcctttaaaatttcatctagtacatggtcttcataacttcattttgcactaaatatttaacaccttgctttacaagtttgataactaccatgtcttcataaaatttcaaagcccatgtgttaaaggaaagaagtatttcaaaactgaacacagggatcccttacttcagactctaggcagactgaataaagaatgataaccatagattagataataaaccgtggtctgtggttaacagaatttttaatgatgacaaatgtgagaaacattcactatttcttatcaaaaaaagattgtggtttttctctcatatctgcaatcttattcataaagttgaaagctactacaatagataccctactttcagagcatatctcacatacaaaactacctttcaagtgagagataaagactgccgatgttattacagaggggctagacagttttattcttagatgttttggatgtgatttactctggctaaaaatactaataatttaactatgctattaatcctgctgaagtgattatgccctccatgagaggctaagctgaaactcatccagaccttcagttggcacagaacacactgatttcctcatatagaagttcagttggtagtggtttaatcggggattatcagtgtataaaatggcatttattcgaacacccctgtgagtacaaccgtactctactttctataactgttgtccaaaatacttatttacaaatcctttttttcccaatctggctcttctataagagataaaaatatattttcatttgatataaaccaaaatacactgagagttcatgaaccttggatgggtcaagggatgtgaagtaaatcaatgagtaataacagcaattacctaaaatacttgcagaaagaaggaagagagagaagaaagatgggaaagaaggctgggagaatgaagatgtctactcagtgtctctgatgagggttggtcgatgaagcacccatattatgatctgagaggcagctgagatttgtgcacttctcaggagagagaactgctgtctcattttggagaaatgcttataactcttatcaagtggatgtgcaaaacctgatgtacataagtaatttattcctattcctgattactaggctacaatcaacatcagatatgtcacttagatgtcccaacttttaaaatttactgacatgtattatttcagcaacatatttgagtcccttctctgtagcacctcttgtctaagtactgggataagcaatactgatttcattcctacttaaaagaacaaacaaaactactttgtttttaagtcttacagtcttgattttaaaaatccaaaaggcttgaatttaaagagtctaaaaatccttaaaatgaaactcttgagtagataaactttcttaaaaataagtatttctataagtgtatttatatatgtacataaaagggtgaattcaacttctctttatctttagactcttgtaaaagttgccattgaaaggcacatctgatacggcaatttcagcacagaacatactcaataggaaacaactaactagagaactaaagatgtaccgtctttgagtcttgctcattttttaaaaaaatcactaactttgaaactggtaggttgtcccacttaaagctcttgatttttaattgccatttctttttacacccaattaaattgtcagagtagtgaagaattgcccaactgagtagaactgtgaggatcttctcactgctgctttccgcagtcttaatttgcagatgcttttgcctaaaataaaaatttaaagtcacttcctcaacaataagacctgtaaagcttccaccaactgctgtttaagacagacgcaaaaagaaaatttgctgcacgagtttggggccatagaaaaaggaatattttcctatatttgtaagatatttgggttctgaataacagattaccatgtcccttaatctgatacatattaaatgaagaccacataggtaaagggcttggtacctttcaattagctcagcaagtctatcaactggtaatattcaaaaagaacaaacaaaactcatgctggactgttcattttcatgaaaacatattgtgtataaagccatgaatggtgatcaaagattcctgtgaataattttcttaatgaaagaggactaattacttgctagattctcagaccaatggtatggtatcttgacaatctccatctaccagaggtttcaaagagaaagccatggagtcataaaacaccaagacaactcagttccaacatatctgaaatgacttgccctcaccttttaacttcctgtggttgcctcaaacatttaagaaatatctttattaatttacttatttattcttgtttttagacagagtattgctctgttgcccaggctagaatgcagtggtgcgatcttgactcactgtaacttccacctcctgggttcaagtgattttcctgcctcagcctcctgaggggttgagactacaggtgcatgccaccacacccagctaattttgtgtgtgtgtgtgtgtgtgtgtgtgtgtgtttgtctgtgtttttttgtttttttttttttttttttttttttaccggaaacagggtttcaccatgttggtcaggctagtctcaaactcgtgacctcaagtgatctgccaacctcagcctcccaaaatgctgggattacaggattgagccactgcacccagccatacatttattttttaattgagacataaaagtgtatttaccacatacaaaatgatgttttgaactattatgtatacattgtgaaatagttaaatcttgctcagtaacatacgcattatcttacatagttaccacttttgtgtttgagaatactttgtacccattctcttagcatctttcaagaatacaaaacattatgaactatagtcaccatgttctacaacagttctcttaaacttactcctcctaactgaaatgttctatcctttgaccaccatctccccaacccccacccctcaacctgctcagcctctggtaaccaacattctactctctactactgatatcaatttttttagattccacaaatcagtgagatcccatagcatttgtctttctgtgaatggcttatttcaattaccataatattttacaagatataaagaggtataacaaccaaatgcattaaaaaaagaagtaccctcttaactagcctttcagtgataactatgtcttctttaatgcctttttaatgcattttatttttcacaaccattcagctcttacatcccactccaccccatctttttgtgttctcagagctctctttctacccaggttacacagaaactcaaggacgatgactaaataaatctccattacacaaccaactcagcagcccctcttggtggagttaaggtatcttttacacatcttcatccttttcctagagacccccaaaacaaaaaaaatcaacccttacacttttctatgtcacattacactcgattgtatcctttgcaagatagcattaaagggcaatatatgaagtagtaaatacagaataaactttagagtcagaaaatctggtaatcaccacatttaccagcatgtttggtcaagccacctctgaatctcagctgctctgaacttgtagcctctccagacactgcacacagaccccctttagtagtcagtaaagcacttagcagacctctcctttagggctaagaatctatcagaacctcagatggaacacctatatattaaaattcacacattccaaaactgcattgaacgcttggtaattactaattctctaggatttttttcctttgtttgatctttgcttttctaattgccaataaaacctgagcaagcaaatagaggttctgtatcatttgctcattgagaaaagaaatctgaagatcttctaatatttatcttacagacaaacgctttaaagaagaagcctaaaccattcctgccttctacctgtctcttctcctttaataaacaagacagcatgccgctcatggagaatcagttcagaaattcatttgttgaattttagtaaataatgccactagactttagagctagtttacataaaaataaaaattaagaatttatagtgtctaatgtcttgatgaaaaggttattttgcatcagtgatggtggtggtggtactgttcaaatgcaatgagaggagatagaaaccttgacctttcagaatggagaaattttaaccaggtacagtccagttaatggcggggggcagggggtggcagggaatcctgtgtaatgtgcaaaaccatcctgttacaggagagagcagtggatgtgtactgcctgtgtagtattgtatgttaaacagtaaaggaaaaaaatagtaccaagatgttctccataaatttagaaacagaattataaacattgggcaaagtcctttcaagtctatattaagccatggaggattgtgattcaggaaagacattcacccctctacgtgagactcacattcaagtgctgatgtacacaagtaatttttcttcaatcatatgtaaagtacaatgcagttcttagatcccttggccccatcccagcagcggacctagatattattaagtctaaagcttacgaaactttaaaggactactttatgaaaacaaatgcaaaaatcttatttttacaaattttagaaaaatatataatcaaccggagatactagtaagtcttcccgggtctttggaaggcatcgtacaagggagggccctaattccaaagattcctcaactgcagggtaagcctgtctctgcttcaactccacaccaattacttcccctccaccattctgagagagattttctggcacccgagtatggcaagagtttggtgggggtcttcgaacaagaattcatctcactggaggacacaggaagcgtggtccctgagcttaatcaatgctgttagcatatagttaaccaggcttgtgtaaaagacatcacatcagcatttcaccattatgcggtaaagtaattttaatttttaaaaaaaatttgtttgtttttaaataatcacaatcatatcttaaaaatgttgatagggaattaagaaaagattggctcaaaccccagtcgtactgggcaaaaccccagtcctactgggcagcatttagtgtcctccttggttctttgtactaggtttatggcaaatccttgagaataatcatttaagtcagagtgaattcttcctcccagatgatgatttatctgtttgtaagctgagatgagggaattccatttgctattgagccagtgagtgttaactttattaacgcatctttgcaactaagattaatgggacccatagtaagtcagctgtagcacttgatgtcagtttataacaagcttggcaatacctggaaattcagatctatcatcataagttataatgacatgcataaaaatttgagtgtaaataaaaggctctttaggatacagggctctaatccaagttgttcaagccttaaaaagtaacttatataacagtgttcctgttttggagtacagtatatgctaatggcctttcctcaagggttaaaatgcctaaactaccatcttctaataaataaatattttattacaaaaatcaattttgcttaatgaagtcctctgagggagaagatgttttaagacattttaccagtacactttaaaatcattttgtatttaggtatgctctgtcatctccacctagagcaaaaaagaatcataaaaaatgataagtgcagcaataaaaaactcctcttactattagttgggagagaaacaaatgggtatattactctgaaggtaattacttaagtttttttattgcaccatattttctcaaaaccgaaccaaagtatatcccaaatcttcctacaaatgaaatacaatttttctctcagaacatttttactcatcaggacaaaaaggtgagcttaattcttctgtcagctgaggcttcatgtgtcaaacacatcttacatttcaacaaaccttactgtcatattgatggaatattcaaggagacattagttcttacggcaagtactagcttgaaaaggtgtaagctgaattactgtgagagcacttttcttctaaaaatagactttattatctccaaccacagtatatatgtataactgccttgtcattttaaccaaatttatggcttcccatcagagattgtagcttccttgaaggcaagtgggggtagtttctttccatctttttattcccaacacttagcacacttcctggactagagagagctagattatcaaatgaataaattcatgaattaatacaaattgcttctcatatattgtatgcctatccgagatgtggaagcaacatctcctgacatttctaatttttaaaaataaaccttaaatccagcagtctgcaagaaaataatatttagaaactttttcctaaaacttgtcattcattcattccatcaagaaattttggctggtagcagcggcttatgcctgtaatcccatgactttgggaaaacgaggtgggaggatcgcttaagccaagagttcaagaccagcctgggcaatatagcaagacctattttctaaagaaaatttacaaaatacaaaaaaaaaaattagctgggcaagatgactcatactatagtcccagcaactcagggactcaggtgggaagatcccttgaacataggagtgacaggttacagtgagctatgatctcaccactgcattccagcctggatgacaaagtggtaccctgtctctaaaaaaacaaaaaacacaaatgtttatggaaaatgtcaggcactgtgcttactgccatgtgtacagtctagagcaaaacaaagccatgcccttatggaacttctagtctaagcatgcaactaactctgttttttaggataaaaggaaaatttcatctaattttctcttaagtatactcccctatcacttatgacagaatgatgttcaaatttcaaatattttgtggatcctacaacagccaaatggtggcatctggaccacatgattatttagtggacaaggtagcttgacttaaggattaaaaaatttgtgtattcccagccttagcaagataattctgcctgtgccaaaaagttctgcttcacaaatggggcagttccctttaatcaaataatttgaaattaactcttaataataatcctactgatcatagtaatactagtgatgataatgataatcacaacaacaactcacatttcctgagtgcctagaactttgctaacagctttacatggattatctcctgtaatcatcctcttaagtttactcaataggtcttcttatctcgacttgatagacagatgctgaagcttagagaggttaggaaatgtgcacatttgccgcaaaacaaatagtgaagttaggatttgaactcgggtctgtctgtttgctgaacctacacccataactacaccttctatcacttcctacaccaaggttggtaacagaaataatcaaaaaaacaaaacaaacgaataaacgaaaaagcaagaaaatgtttcctattatctctttcaaagtttcaaggatatttgaaattcttctgcttcttctaaaatatatctaatgttacattttcacagaaatcataaaacagttatagatttttatctagtctgtgacctagatgtcatagaacagaaataatattctagtacgacagtgtgactctagtttgagttaggcagttgaagcaattgactacctggacctacctaatgtataagcattctgaagaatatggaaatgtgtgttaacgtaacaataagcacaaatgtaacagggggaaaaaaaggaactaaaattcttgggattgtgtactagcatagcaccaataaatgattttcagtctttcaaaataacttggtaatactgtatgttttcagattgttgtatcatcctatttccttgtgaaaagctgtttttcagtcctttggattaaggactatttgagaagacacaaaaacttatttttcagagttcttcaccctcccttcccttcaccatagccacgtatacatataacacttactgaattactatgtgcctagcactattctagatgctggggattcagtagtgatgggagagccaaaccagctagctcagcttcaaagggataataaagggagaaggaaggaaattaacattctttggcaactttattgttagttactctgccagatgatttaatatgtcattaacttcccccaaaacagccctaaaagatagccaggatcacccccaaccctacagataggaatttaacattcagacttgagtaatgtgtctaaacctatacagttaggaagcactggaaggttgatacaaattcatgcttatgtagctagaaagagcatctctcttcattccctctgtttcactctgtctttgtagttctctttccctttgcctcgacttcttgactctcaatcacgctcttcatcttgcagaggccactgaaataatgactattttgttcattatatgtaaagtaagactcattcttacccaaatggtctcttaatgcattgtatctacataaccatatctatagatccctctacatatgtacctgttcatgccacaaatatctcttgggtgcccaataaatgccaggaacatttctaggccatagaaaactgtaatggagcttatacacaaaggaagaggtatacaggataaaagtctcaagacataaagagtataatttcacatagtaaaaagtgctatgaagcaaattaaacaggtcatatacaaacacactatatatatatatactacatgtacaaaacatacatatatgcaaatataccttctcaagtttttgtataaatattgatagttaataactagctttattaaaagccatcacgtttttatgagcacatacttttctactatacttaattttctagttgaccagtaaatgacagatctgcagttacccacgtaattaaacaaatacataaacaaacagaaagaactatgtatgccgatacttagaaaggtagaaaatatctaaaaactgttaatattgattttctggtctcacttatgatttatagcttcatttttttaatagctcttttggtatttatgctccaagaaatataggatctcttctgggaaaatacaaactatgatcaaattttcaacctgaatacagacatcatcagacatgtgagaaaaatctcaatagtgctacacttatgaccaaaaatctatcaattaaaaaaaaatctactgtgttaaagggtgaaaataacatttatgtaatgcatggataaagtttaataatcaaaggtaaagttctaagaaacaaaaaagaaaggcatggaaagtttttagatataaattaaaacacagctcattttggaagatgacagataagagagtcttgaaatgatatgactattccccgattgcccagtagttaaaaaaaaaaaaaaaatcttgctatctttaacaaaacatattaagaatatgggatgtgtgtcatcatagttgtgtttaatgtggcattaattcacaagtcattgtttttttaataagatataataagttacttgctcttctaaggagatacgtaattagggctttgataattaaaccctagatgaggcatttggcatatctgtgccctaaataccaataaattatgcatgtacaacttttaaaactacatcttaattagtagcttaaaataaaactaatttggaaaaccaggatactgaatttttaaaaactgctcaaattttatcaatgaaagccaaccaactacctagttttaaatataaacctcaattatgtatgaatgactgtttgatagattactttaagtgaagtattttagtaaactcctttgtaattttcagctcacataaagatggcctaggttaacttaatcacaccttttctcacttattaggtttatctccttagccaatgagtcacgtcccaacctcattttcttttactactactattttacttctgctcaattctgacctaccattgtttatacccacctgtaatggttaattgtacgtgtcacttgattaggcgaaatatctggggtgctcaaatatttggtcaaatgttatcttgagcattactgtcagggtgtttttggatgcgattaacatttaatttagtcaccaagcaaagcagattgccctccctaatgtgggcaacccttatccaatcaggtaaaacactaaagagaacaataaagctgagcctcacctaaggaaggaagaactcctcctaccttcaaactgggacatcagctttttcatgcctttggacccaatctgaaacatcagctcttcctaggtcttcagcttgccagcctgtggactagaactgcacatcaactctcctgggcctccagctgccaactttggcagatcttgaaacttcttggcctcattaataatgtcagctaatttgttaaaataaggctcttcctatatatgtatatattctgttggggttctctttctccagagaaccctaatacactgcacacacctaccatcaatactcagtgatttcctccctaagccactttgctcaagaagcttctagtttctactcctctctcaagttagctctgtctcacagactcctaaatattcttcatgccccaacccagcagtctcctcactctcacagtgtatcatccatgtagcattttacacattttgcacccatggcacttgagcactttttatttcccatcatgctcatctgtcgacatgtcagctggaagaacattgttcttccaggacaatatcttgtatataaagtaaaaatctgaagggctgaaactcactgtcacacgtactgcagcagggatcacttcagacttggccaaacccgatgaaaatcttagctgtacgaccaagaacaaatcatgtcaaactctctggaccttggctccttacatcaaaaataagtagtgaggctaggtaaacaccaaattcccttctagctcaacatttctatggttcggttaacaagttaagcagcagtaaacactcgcatgagttgatgttcatttcaaaattattaaaaataatattttaatatgaagtcaaaagaagaaaattgttctcacttcaatgcaatgatttacaagtgtgctcattttttctgagccctttttagacatgatctcagtgtggcaaaacaagtaatagttccaaggaaggagcatgcatcaccaacataacagtcctcaaaagatagatcagaaggaaaatgaatagcgtctcctcacaggtacactttctcccccagattttcagttttaatgtctccccttactagggtctctcatagactatccacatgggcttctgtctttgtgaccactgatacccaaagaatcactgtttttaaattctaaagattacaccaacgaaagtcaggagcgtctgttcacttaaagtggctctgcccactaccaccttttcccagcatggaaatgaggtacacacgaaagctttatcgtgttggtatcaatgtattccaagtactcaactattttataagccttttcaagtaatcttcagtcagtaccataattgtcagcacgtttgttctgtgttggccacccttccttttgtttcagtctttcataaaaatccttttgtgtgacagtcaagcagctgtgctttgttctttaatgttcctagcctggatctccagccgagaccactttataacataaacggcaaagtaccattttcacagcggggacaactgtgttcatcttcaaaaagaggcattaataaaatgagactgtaatcaacatgctaattctgatcacagggtactgcacaatggcagagatagttgactgccttctccctgaaagattgtaaaagttgtatgttttttttcctaacaactgccataatggcttacattttttgaaacagacatattatgcaaacatttctatttcccattgcagtgccttctctgtctcatccaactgctcactgtgtgttttactatctcagtaacagtcaccttcagggagcaaattttttccatcttgcaagaactgacttgctgaaataggcatgtcaatgaatcacggaaagctggagaggggtgatctgagtgatttcatcgctaatccaaggccttcccaatgcatatcaggccaaaaaaaaaaaaaagaaacagaacagaacagggaagttaacgtatttgcttaagaatccagttattttgtgacagagctaaagctggaattcaatttcccaagacctagacttgggtacttcacgtattatcttttgtcctaatggtgatcattcacaaataatatatttatatgtaagagtaggtacacataagtatcacttgatgaaatatatttgctaaactaggtaactaaaatgcctcatatctggtaaactagcatgtttagacaataattgtactgtagatatgttctatgaacaaagccagttccctataaatagataagagcagcagtgttgtatatcataccctgttctgttgtgctagtggtggtggtggtttggggcagtgctatttgagaacagcccagtctaaaaataatctactaagattttttaaatgacccattacatgctgtttgagataagagcaaaataatgtattttctgattactcccctaaaaaaaattctaagttcaagaaacatgatgacatttagtaagatgcttagattcaaagttgattaaatggttccagaactttgtcttagagaagggaggttatgtaagtaagaataattattgatgtctttcctcttgcccaaaagaagcaagtacccttggactcttactagaaagaaaagtctatggatggtgatatctcattttccctgcctagtgattgataacatctatcagagagaatattttcatcctcagttatcactgcataaatttgtattacatggtttcctgctgatatctttagtcaggaagaaattgtgaccagcaaactaacgaaacagacagaaccaattccatttagatgacaatccctgttcttacaacactctctctggtcctatgcttgctcttcactgaaagcctgatagttaattcactgtccttagtagcattccacaattagttaaggcacagtccttagtagcctcagtacatcctaaggccttcacttaaagttctgcttaggatgggaaaacacaagtaaaacagatatactcagcctcctaaagtgttgtatcattagggagtcagtattttcttgtgtttccatagccaagacaactaaaaaattaaaatgacttggaagacataagccctacattcacctcccccctctcctacttctttcgtgaaccacactctatggtatagttaattgcccaaatatcttatttcggggcacattcagcctgagcttgtggttatccctccttattgaaacacagtttttgagagtaagggtaatttgaaacaagctacgaagggaaacttgttcctgaaatgctcccttcgaggcacatgggtggtcagagtattatttcaatgtcttcttcattaaccatacaggtcagatatttgaatctccaattaattagtttctctagtagcttgtgtgagataaatcaatgatcttcatccagttcacttagataaagcccatcatgagagctggcacatttttggcatttgtcagtaaagcagggagaaagtaaatgatccacgtggacgaaatgggaatctaatgaggccactggacgaaaagtgtaaaatggtctccatctactgcagaacagagtgcctgagtgtccgccaacatgatttgcaagagaaagtgaacctaaaatctcctcaactgtggtataaacctcttcacactcatttatttagctattcatgatgttcaaagtctatgaatgtcagtttacactggaatattattaaacactactattaatagaaataacaatatttagaagttttaagcaaacagtgactccaggaaacaaaaataatttccatccatatttattttatcctaaaaggatatataaaagtattctattttaagattatgtttagactacctttctgtcatctaaaatacttttgaatttttctcatgaaagttctaaaactgctcaacatagtctttaaaaaaatggaaagggttaactactcaaatcataaattttcatacaagtatacttacatatgacagatgttcacatagaaagttgagaccatattaaacatttttgatgcatttgttttatatggggactagctgtataaaagcagaggagatgatgaaactccagccaactgagagacaggaaaacattaatccatgtaaatttctaagtaaagtgatattttgctccaattttttgttaatgtcttcattggatgcataaagataagtcaagcacatgactgccattaattccttttaaggagttcaagggatttggaaagtgagaaaactcaaaaacgtttctgataagttttattttattgtacctttttaatataccttctatatgatggcactgattctaaactaggtaaataaatggagattaaaatttttaaagcagatgaacaaatgagccagatttggcttcaaatatgaacacctgaaaaatgacaattttcagacaagctgaagtgaactatgtatgtatattcagaaatatgtatactttccatagtgcatattacagcacatataaacatagtctctaagattcctgccagttctaaaatctaatttctaactcctattcttttttttccctaatgtcttattcttgcctattagaccattccttcctttcccttttcaaatattttaaatatattttgaaacccattcatacagttcagttacctgtggatcagagactatgatttccacccttgatggttgggcttactgtcgcttgctggtggtagctgacttgattgctttagaactggtgttcattagcccatctgggtatgaacaaccttctctagggttgtgtatctggattatcggaatgtctctgtggggtgagtgctattatgggtgtctgttgcacactctatgggactcactgtttctgaccagcttttatgttaaactatttggtcctgagtattgcacagtaggaatagtgctggaaatctcacttgtatgcagaaagctgatctagtctctgttactctcaacttattttatatacgtatgtatcttgctggagtgttaaaactccagcactaaagcataaggtccattttgttattatcttgggttattacaattgtcttttctctaggaaatccctcccttgtttttagcaactggaaatttcaatttcttgtttgtaagcctaattatgcttttaattttattttcagatactttgtcaacatttctatgtgttggtcagggaatggggaacttcctgcaccaacctagcttgtcataacagccagaaatgtagctcaaatctcacttgtctgttttaaagcagcatctgttacatgcatttaaaagatatacatccaattgtcaatactttccctgcaacttaataaggtgtttatactatttcaaacgtaattaaggatatatatgtaaataatctcattttctcagcctcttgaattgcttctttgtgtgtgtgtgtgtgtgtgtgtgtgtctgtgtgtgtgtgtgtttagtttcaaaaccaccaggtaaatttgacctacattactaattactgctggcctccaaataaataagttcttgacaatatcaatagggcttacctccttgaaagaaaccaagatgtttatcaaatcaaacttttttattttataaaagatataaagtaaaaccatccctccatgggggtaaaaaaaatgaaatagtagagaaatgtacttaatctacataagttcctctatgattctgattgtttcctttccaatttctttcatgttaggaaagtctattctcctaaattttggaacagaggaaaatacaacaaaacaaaacaaatgagttgtgtgagggagagaaagagataaaggcacagaatagttaatctggaaatgtcaactgtgaggtgcctaattgggaatgttcgtatctctatacagaagcctgaattagagacatacaacacagtcttcatcatagctttattctccagcactctcattgtaaaggaagtctacaaactgaacacactgtactggagatctggcaactcaccctgtgcctttgtcaaattgtgtaagcaacattgttggagacaaagaaagggatttgtcagcccagttatttagatcaatacatattggtttaagaaagataacagacaaataaaaaatgtattttttttcacataagacaggtgcatttcttatacttggttctgaccaattgcttaaggaaagttcatctttaggctaaggttctttctttaattctgcaaatatcaatgtcagctgtggtagttgtaaaaaacgtagctgctgaatacagtatgaaaaatccatgcacgagtaatgccaacatataaaagagtaccatatcctgtttcctttctagatgctctgccaaaaatcaaaatggtatctggcatttgaagtcaatgcttttttcagcttttttacctctgatattccccctgaactctagttctgtaaagacccaaaactagagaaggtatccactgtctaattaaagttcaagtcttacaaacatttaactgagtttcccatttaagcaccatcacaatgctagtcttttcaatgatgctacaaaagagatacagaattgtaacaatgacacaaacgacaaccttcacttgagcacttaccccgcaaaactgtgagtctggtggatacacttatttctcccacattatttgaggccacacattcataaatggcctcatccctcggagtccgtaagggttgtattctgagaactgatccagacccatcgtcaaactctattacctattagaggaaacaatagctgtcacaggtgttgttacaattgtctacctctcagctaaagctctcaatacagtggtggatccgccattaggctcataataaactaggcatcattctgaaactgaattttgatatagtggtgaaaaaatatttggtctaatttagtgaatcttctactgaacaaggagaaagatatgcaactacatatgcaaaacatggagatttctagtccctactaaaaactaccagggtttattcattaaaatatttcagtatgttcatctagggcaatttgactctattaattttgcaagaggcttgcagctataatggataaacttcttaaattattctttctctcacagcacatatacgaatgtggattcattcaataatgggactgtaaggtgaagaattaatgcatgccaccacagatagctctgctagtttaaactgtctcatcctgaacagtatagataggcaaaccacgaaaagaaattgcataaatctagtacttaggcagccaacgagacagctttcacaacccaaaagcctgatggtgtgcattaattttgccataaatcattccagtatttgttctagcttagcattttctgcatttttagagcattcttgctgtaaaatggaggcttgcttcaccaggcagaaaattaatgtcctaaacactaagcctgaattcaccatcattaggaactcttcttggaaacagtttagtgacactgataatcctgggtacttgttagctaattcaagtaccacttaaaaaaaaaaaagatgatgatattaacaaatatgtatacaatattatggagtcctctgtcttttctgtaactatgctgcattccttcagctgttcactgagaagttgtgccttttttctcttgtatttcactgtgaatattcccatgtgcctaaattatgaataaattgagattgcctcatatatatatttatggggtgcttaattccagattttgtgtgtgcatgtgtatattaacacagagaggaaggacattcatattttcaaaatatgtccacttcaatctttgtgcattccatttttgttcaaaattcacaaaaatattcaaaatggcccatttctcaatgcactacagtttattttcaactctataaagcatacactttaaaataaatctactatgcatcttaggaaagaaaagtttcatagtttcatattggaagctttgttaagcattccataattttaaaaaagttatttatgatcattttatgatttaggtaggaaaaggttaaagcaactataaacccaatttaaatgttgactaatttattaataaatgtcattgtatgtttacatttgtgaactatttcctagatttagatctatcctcttacaacatacaatataccacacattacacgccagtgatgtaatttccagtttgaaaatatccagtattgatttcatgcctgccatggaccagacaccatacttagcactggggatagaagagggagcaaaaacagtcaacatgtactgctctcagggaccatacagactagtaataccatatatattgtttaataatatatatttaataatatatattaaatatatattatatatatattagtgttaaatatagtaaagattttcaaccaaggacttgatacagtttgatgaagctgctttgggtaaaaataattcatttaccccaaaggtgtttatatgactctcatggggaattaggcattgagcagagatcatgctgtgaaatatttagtagtataatttcacttttgttacatgattttgtcaggagccattgtcattagaaagcgtgatgtcaaacttctctttgacaaaaaattaacttcatttaaatttttttaatgtgcagcaaagatgcatacatacatcattttctacatgacacaggaaacattttccaaatattaaagatatttttgtatttaaataaattatatttcaataataatcaagtatttgattttcagacataattttaaacttctcacttgtaaactacaacccaatttccaatggcaaatttctaatttcaccattgtaattaattaggttctctatacatttgaacccctgatcaccctgtgagttcctatgaaaataagtaaaataaaattgttctgaatttgtagttgctatatttcttttaactagaaattgcctttaatctgccaaactgtaaattaggtcatgaaggagattagaaactcaggtaaaagggaggtgagtttcacaatttcaggcagtttgggggtattggtagcccctaaaattaaagctatccttctcatgtcttaaattatgggcatgctattgtgtgcccataatctgtgtagctttctatatatcttattgcctatatttctcctccagaatgagcaaatttctaaaccatcagccttctcacaaacactcaaaaaaagaatctttgatttatgtttcaccatcttcgctgcactgagctctcctgaataaagaaaaccaacttcttcgataggtttctctgcaatatcaacctgtttgcatgtgtttctttcagaatagtactttaaaacactggaacaaatttctcattctagttcacactacttgtaaaacacaggtgcgaggggcagtggaccacttcatttgctgcttagcatccattcccattcttcttgataacgaggatttaaatttcctttgggaaaattctgctctttcattctaagccatgcaattggatgggactgtcctcattcccagaacagaggtagattctgattggcttaaattaagtaggctacactgtccacctatccacacaaattgtctcagggatgcacaagtaacgtaataggagccaatgggatgagaggcttctggaagagacaagctttcatacatcctacagacgtggtcctgtgaggttgcagagctccatcttgcaacctggggatgaaactgacagactaatcctaggaatactattgagccctggcacaagtagaaacaaaaatcagcccttgaacccccaaatttccttttttaaaaagccatttagagttacattttccatcacttgcaatgtaaggaataccatatatcagtgacaccttttatcagagtaaagcaagcaagtaacgtagaaaccaaagacagagcagatacattcttcccccagagaaacagaacaatggacctaatacctcaaatctctgattgctgactttctttccttttttgttccagacaattttaggtcttgggtctcccgtagcttggcagatgaaagaggcaactccgccagagacccctgtctgatcaacgggtgttcgtgtaaaccttggaggtgctgaaataaaaaataaacatcacagttaaattgaaaactgaaatacagactattatcctactaccgctgctctccccaccatcctcaaccacaccgccatcaagacatacatttttacaatgcactatgggattacaaaattagaaaagcatcttttacttttgagggtagtttaaaggggaaggacataactttctggttaagttatctattagtgcttttattgctgaaatctgtattaaggtagagatccaataacatccgaaaagcaacatcacacattaatttttattaccagtatataaaaaaatccaatttgtcctctaacaaaatgagctcatcaatcaaagtgggtaaaattttagcgcttgctttgatgccactatcaggacactgccagaaagcagcattgccactgctgagctattaaaattagtgacatttaagagaaatgctaggaaattttaaagagacaagaaatatcgccctgaattagaaggtttcgcaagaaatagaaataggggaaaatggtaaagtgactctctaacccagatattgtaagctgtcttacttgaaacttagctccacaatttgcataaaagaagatgagtcaagaagcctccaaagtcatagtaaagcaaagaatattttttatacaaagatgtagacttaaagattactaaggctagcaagatagacattggaagcttgttcaacatcctccatctcctttaaatgttcctaacattcttcctccttctttaaaaaacttacttatttttcatcttgtatttcaagatctagatagctatcatacaagaatgatataaaatgtaaatgaatacttatgcacaaagatattcatcatatcatttgtttggcaaaagagtataagtagttgaaacattaaacagtatgggatttctgtcacagtgaaataaaatatggcatgaagatggaacatcatacaagtagttaagtgttataaaatctgtatcataccacatgagaaatgcttatgatgcaataataagccacaaaagcatactacagagttatatgtggggatagcagataatgaaaaatgcacacacacacaaagattgaacaaagtaaataaaacactaataatggtgttcaggaggaggcattttaattatttctccgactgctttccatcttttacacttccttgagtttttacaattatgttctggctgaaaatgttttaaagccccaaaacattttgctgttccttcttttttttttttttttttaatttctaatccctgttacagattttctcttctctcctactgtgttctacttacatgtcattgaaaagtggttttaaataaccatagctaaaattgattttgaaaacaatccttggattataaaaaagaaaaaagtcataacaaagtttgttcttcttggttcatcaccagtatcttctctgtattgatttcatgtttcccacatggtgttcccattaacttgatggtgtgttctgactctgtttggttttcttggagtcaaggaagccggattcctatctaagctccaccaatacatatatggataatcttggaggaaaaaaaatcatgtaactttaccatttcttggtatgacatatgaaatacattaatttacaaaaattgcaaaactatgacatatgaaataaattaatttgcagaaattgcttccagtttcaaggtttcctagctttatatattatttccaaaggagggaagttcagaagaggcatatttgcaatgctggtcctggagaatgaattaccacctcatcagcaaattcaacttgttggtgatcctggaactgcgggcctgcttatgttcaaaaatattaagaaagcaaaacagcctctaacaaccctgctagagatcataacctgtagcatctcagtgtagcaatacagactagatgattactaggagctgtgggaagtacttaaaataattttattttttatttatttttatttatttatttattttagatggagtctcactctgtcgccagggtggagtgcagtggcacaatctcgactcactgcaacctccactacccaggttcaagcgattctcctgcctcagcctcccaaatagctaggactacaggtgcgtaccaccacgctcagctaatttttgtatttttagtagagacagagtttgaccatgtgggccagaatggtctcgatctcgtcacctcgtgatccacctgccttggcctcccaaagtgctgggattacaggcgtgagccaccacgcccggcctcaaaataatttaaaattgactaacagtgagaggattacaaaacactgtacattgatgtcacttttctggaaacaaatgaaaaatatattacaagtttttatatttatctttctgctgtttcaaacaatgcaaattgataataactacttgcttgtcagtaaccaatggaaaaattataattatgcaattaaaatttctagggaatttccctagaaacacaaaatagattgctgtattaaatggtacaatactgtcatttttagctaccttccttttcttgtccatagcctaaaaactgtcaaccgggaaggaaaatacattgtaagagcccagcttcccatttaagttctgttctgaaatttcttgcaagaacatgtgaatacattgaagggctgttgcataaaatgagtgtgcactatattagaaattaaagaaaactagaagtaggatacccttttccctgcatctggatattttttaagggataccgttgcatttcttaacccaaagaatgaagaagagttggcaattctgacaatctgcaactaggcaatggatgcttgggtaagtgcttcatctgtcctgttgccatgtaaggacctaaattagaaagctcatctggaaataactggtgggtgaggacaagtcaaattaaacatagaaatcttatttctaaatggagtgcagagagacaaaattcccatacacttggagaataggtatgagtgccatttcgatgttttccaggtatgtgtctcatttatctttattttctggtcaggcattgaagttttttgtttgttttttgagacagggtcttggtctgtcattcaggcttcagtgcagtggcacgatcaaagctaactgcagcctcaacctcccaggctcagtcagtcctcccaccttagcatccagagtggctgggagcacaaccacacaccaccatgcctgggtaatgtttttattatttgtagacatggggtctccctatgttgttcagcatgtcttgaactccagggctcaaggatcctcccgcctcagccttacaaagtgctggaattacaagtgtgagccatcacgacacgcagagaagtttttgtgtaatattgacaagtataaaaatatgccacccaggaggcagaggttgcagtgagccgagatcacgccactgcactacaacctgggtgacaagagtgaaactccatctcaaaaataaaaaatttaaagaaaagaaaaagaaatgaccattggatgctactgtaggattttatttctggagaccaagtcatggaatgaaattaacctattgaactgtggtaaacttattaaaataaccagttagaatctattttaggacctggaactatttttctaaatcctaccactgtattgatgtgatattcttaaaaaacaaaaaaacaaaaaaaaaaaaaacaaaaaaacctaaaagggctcttaaatttattctttgaaaacaagaaaataaaattgatcacactacagttaaataatttcaggggcttttacagagaaattctgtaaaaaaaaaaaaaaaatacatatatatatatgaaagacatcggcctcactgacaagaaaatcatgactttcctatgggacccaatgtcaatttttctagattcgcccacaagatccgaactacaaaaaggatatatgtcatcatcctatgatacaaagtaagactcaagataatatagtaaaatcctttcactaagcatgggtggtgcatatataatcatttttgctggtcaaactctcagatggtgtctgtcaatgctaggcagccagccaaaggaaagatatgaggtagagagaagactaaacttaataaccccaacaaatgcttgaggcaagtaaaaatctttattctcagagggatataacaacacacatcacccacttcccttctccatatctcagtttaataaaaggaacatgatgaatcgtctgccttattttgtcatagatattgtccaaatttaagccatgctctgaagatgggaagaaagggaagagaattcaagtaaagcataaaacaagggtatctactaaaaagtcacaacataggacagactaagatttgaatcgtgaaaatctccgtttttatcccatgagatacaaccatcagtattatagttagtgtacaaaaaaaagaaatatcaaggtataaagatggggagaaaggcattagaactttccagtcaccattatttagagaggcatccttccattactgctgtagctaatcaccattgccatctacctgaagctgccaatgctgtactttgcaaaatgcatttgtgctcaagttggttttgacaagtgaggagtatgatcttttattaaactaatgccaggtactgcacaggtcaaattactggtcaacccagaaagtctattttctaaatggaaagtagagaagctacgcatgcatatgcgtcacaacagagacatggccgatattctagaatgtgtctgccaggctcgcttgccattttcaaagactgtacattctcaggatgcattcacaacacaggccatagctcctggaatttagtagattattatttgctacacagctcaagagaagccacaaactgcgcactgatttttgcttttaagaagttagattgtttcttaaagtctaaccaatgcacagtatctttgaacctaatgggtctaatatttggatgccatatcatgtttcaagttgctaggcactctgaagacaaggtgatgagctcaatgtgcacttatagctattaaatgtaggtgagagaaccaaccaagaccagcaaactgcttttgtctgtccttaacaaactgccgtactgaggacaaaatcctccctttcgtacactatactaagtagtgctagacataaatcggggagagccattgaagtccaccagtaacatccacagatgaatgcaatttatgagaaattcctaaaggttaagtagataacttagagttgaggtatatgattggccaactgacttaaaacagattcatagaaaggatcacatgctacaaaagtgaagagacaaaatgagggtgccatttatctaatttaattctaattaataagctgtttcttgtggacatcaagaaaatatgtggcatggggaacaaaactaacagcatgtaacgaattggctttgtttcttttaactgattaacatttccttaaatacagagttttgtttttaaagggctgtttgtcataacaatgtacttaaaatttttaaaggggaaggtgaatattgctgttaaatgagacagggagagaatgttcagtgggaacatgcaggtacccctgtctttagcaatctgcttcctccttaaaaagtgcctgtagaatttatgagaagatcagctgaagtcatctctgatctttctttctctgtaagcgtcaggatgagagctctgaaggagagctcaggaacagggcctttggggtctggtgggaaatgcagtgcatagcagaagagtgaggggtggttccaagggtagtagcctggtctgaaggtttgaggggaatgagttaccatgggactttacattcccttccagccacagcacatcctattgacactttcgcaaacatggggcatccagagtttgtgtggatgataggtttttgttataattagcttcattttcactgggacaagggtagtgacagacaacctgcccaagtcaacagcacaactataccaacacatgacgaaagggagggaggtcccaaagttgatgtatcattgcttaggagggcaaaagcatggcacagataccacctggggtagcttccatagcagaggttctacatgaaccagggcctgtggggacagtgaatctgtcacatgaaatttgaacagggtcacctgttgacatctgtggtcaggatagatcttcaaaatcaaacagactttcaaaaaaattgtttatggtatttctttttaaatacagctcccaaaaccacctgttagttttaaaatttgatttaagaagcattatactttagaatggaataaagaaataactgctccttgagttccatgcactagactaaatgtttaatatatcttatatacggtgttttcaaagagtcttgcaagatgttatcattactcctattttatagatttatagaaagctttttagtaatataggtattaggaagggagggagggaaggaaggaaggaaggcaggaagaaagaaaggaaggaaggaaaatatatgaaaagacagtaaggaggagtcactgaggttatgagtgagagaacttctgatctaattgtgaacccctcatgatggcagcagcagcaggccatgtggagcggccactgccctcacactggctgcagatgggctgcctcagggacgcagggcataggggaagcggggaataggggacccaccaccaccactgctgcctctgcagccactcctgccaccactgctcgcagctctgatctcagagcagagttgaggccgagcctaggtgctgtcagcctgactgagtgtgcacatgttggggcagcactgagacaccagccccttgctgcctcagcacccccagactttaggtactgaccagggtggaagggaagccaagtggggagctgagggcaactcagggcctgcagatgccccttggcgtgagcagcctgggtgccacagttggtggcaggaggcagacaggctcctgggcagaaggggatggatccggtgaggtcccaccttcaggccagggagggcctgaagtctgagtgctgggctgtcagccccacagaccatagtgggaactggtggtgccttttctgggaccgcccatggctgtccatggaccagctggcatgcacttcatcccctctgaggcccataaaagttccaggctcagccaaagcaaagcagatgggacaaccagctgcaaaaaggcacgactctctctgttgttagctgaacacctgctgggatgaccagctgcagagaggagctaccctctctgatgagaactgaggacttgcttaacagagaggagctaccctctctgctgggaggtgaacactccggacgacctgcctaacagagaggagctaccctctctgacaggagctgaacattcatcaggacaccctgagacggagagaagatgcccactatgggtctcctctgagctttcctattgctcaataaagctcttcttcgtcttgctcatcctccacttgtctgcatacctcattcttcctggtcacaggacaagaactcaggaccagccaactggcaaggctaaaagagctgtaacacaaacagggctgaaacatgccccttgctcaccacgttgcagatgaagagaaggagagaagggctgtggccctttgaggaccccagacctgggagctccccaagccagggctgtgactcactctttggggcctagtggttcctgttgtttccaagtttccaggtgccactgcattcaccagtgccagccagggaagctgctgtggtgctcctggtccaaccgctgcctcacggagaactggcagccatactagcacccggaaccgcccaccccgtggcagcggccaacatgtctgactgtgcagtgaccaaaccccacgttcactcacacaccccttgccattccatgcctgactcgcagtctcccttgaagacatgggatccaggccggtagtgtgagctgagtgcagcctgccaggccaggtgggcagaacaagaccaacgggcctgagcaaaacttggataaaggtgccactggccacagaggtttctggccaggaaaataacaccccaaagatcttgtaacactaatattttcactgtgccaaattacaagctagaaaattataaagattgcacagataatatatcgcaatttattaaatattttgaaatatcttttatgtaactataaaatgtatactgattgtcttctcaagggattggcacgtactttgtgccatactacagcaattatttttcactagctaagtgagaaacttcacccagaatatgctgtatttaaaagttctcttaaagtgtaacatcatcccaggatccaattgaaatcagagattacgatgtctgaccaagagacaaaaatcaatgtcagaaaattcataaacaaatcacccaaattccaagtttagcatggtaggctactttggtattattttacttatacattccatttgctcatgatttaaaaagacaaatacctcaatacagttcttgacactgattaactctcttccatttcaagacacttcaatgacatatttctatgcatgtctataccattaattttatttaggcctcaactctcaattcctttagaatgagtattaaagcatttcccatttggtagatagatatctatgcctctgtatgactaccaatatctaatttttcaaagggctgataggcacactgacagacaggaacagaaaaggagagagaagaagaaagggaaggaagaaatgaagagaggaagaaaagatttaatttagtgaaaagattatctcccacttgcactttctatcaatgttaggttattatttctaactgcttgaaagattaccttccagcatctcaaaattgttgtgttgaaaacataccatgtcatttgccttcccagtccttctcctcttactgagtgttcatttctgtttttggcatattcactctcccatataccccacctaacagcctcagcctcctcttctgccttctcctttgcccacaataccaattattaagttctactgatttatcactaatatgtcttatccctcttttttgtacccaaaaacaatggccatggttcactcctaaactggacattagaatcacctgggagtcctaaaagaaaaaaaaaaaaaatgaaagctacaggtgcctgaaccccaccctaaatcaattaaaacagaaaacagtgcatgggactgggtaattaatttacagaaaattccaacatgcaaccaggattgagaattactgaatgatgccatgatatccatagcttcccatctggtcactctcacttcaggtgcttcatctcgacaatcaatattacactttactatggatccttcttttgttttcccttttcgttctttgagttttgttttctaacgcatctgtgactacagctcttttccgctcaaaaaataataaaccaactttaatagcttactcctgcaaactaacaccagaaatactgtttggcctttaagatatttcagagctgctgtcaatctattttcccaaatacatttccaccattgcccacggagaacctaaaattctctcatctcgatgcctcagtacaggctgttccctcatgtaaaatgccttctttcccacttttgaatttacagaatttacccacatttttcaattctaaattaagtccttggaagccttctttgatcttccccatctagatgaaatgtaccatcctttcgactcccctatcacgctttctgtatcttttatgaatcacaatagtctatatttcattatagttattttaagcacatgtgttttctcccctttcacattcatagaaccttgagaaaattatacatgcccctggtcatctatgaagtcttataactcccaaccatacccagcacatagtttcaatgcatacatgagcttggtaaaggctgtcccagatactatcccctaatcctggactatacacttttgagtatttaggacggataataatatcgtaaatgtgatctttgcacctctattacacgtatatttgtttatagtttggcgaattagctatggaatacaaagtctatgtgacataccttgccactgcaatacattgatatgacatagtgagagacgaatagatccatgcgaagccctaagctggcaaatgtagcacagccagattacagattcatgtgtatcatcataggactgaagtttagatgaagcataatataacgtgatgagtcttttctcttttatgaatatcattccacctcattgtcatcacagagctctcttcccctctaccaccttttgtgtttttaatttttaagtaaaatgactttactcttctaattgtacgtatttattataaattagaaaatgtacatgagttgaaaggagatattctaatggtgatcaccttgatgaataacttttaagaattttccatgcttattttacatattttttaacaagaaagaggttatatcgtaccattattttgtaaccaacgtttcatttagaatatactgtgaatatcttttatgaccacaaataaattcatcatgtttatattataaagagtaaagattacatttaaatttattgttaaacatttaggttgtttctgctatttcaatcagaaaaagacttcaaaacttttttgtaatcatatctttgcacatatatgtaattcctatatgtgaattactcctacatgtaaaattactgaattcaaaaaagtatatttttaaggcttttgatatatttaacaaattatacttttaaaataattcatatattcatagcagcaatgtgtcagaatgtccaattacctagaccactgctaaagctataacttaatactttatcattggccatatttttatccactgtccaaaataatgaattgcaaacatttggcacaatgtctacatacaaactaagcaaccagtaaatgttcgtagaccattagcacagctgaccaaccttctagctctcgcatcatacccattcctccattccagttgccaccatgggacttccctgccagttgccttcaacatctctgatctcacctgggattatttcacattccagaacagcatgcaatcccagcttctgctattcacaacacaagcacacgcattacaacaggacaatacacatgcatgaagaccataacgtgggtcagagcagaaaagtggaaatggtatgttccaatgtttgagggaaatttgtcataattcaaggtataataatacctggatcataaacacgtgttttacagcaacgaaaactgtatgatctcaccatcataactttttatttaataaacagtcatgggatattatgacaaaaacaatcacctacattctgtgtgcccgggcaataaaacttcctgaactattgatgtgcttagtaaggctggccattctgttttggtgtaagacactcaaaataaccactggtttagtgacataaatttcaagaagatggcctaagtggttttgaatcactcatagacaaaatctgtgaagtcattcttaccattccttatgccatagtcatgcattcttaatgaaaacatgttatcagcaacaccatttagacattcacttaacatcttccacattaagcctctagatttgcttactacctatttatgcattcaaaatactcagactgtgcatccgttttgttcaatagagtgataaaaggcccttatactgaaacagatgagaaagttatgcattacatacaatctcccaggctcattcagcagagatgtaggcaaatgacacaatgcttatcagcttttttcatatttcctttaagtggtaacatactcaggaagccatttaatatagacacactatttgaccaaaaagaacctctaccaatgctttagcatctttttgtagagttagttttcaaagcagattcatttacatcatccactgctaatttactcattaatcataatttatcacattagatgtgctgatcatcattaaaaataatcatttattctctattctaacctgctgcttatcatgtacctgcaaattgggtcacacaggaaaggtaactggcttatttgaaaaggaacatgagagcggataaaactgaagtgggaaagaaagagaaaaataaagaacaatgccatctttcccaattttatgttgccaaactccagaatatcctgccacttcttctatacaatatttccagtgtatcaactacatgaatttttaagaggaactagtgtgatgaactgtactagcttcactttagaaacagtagtaaaccagttccacaaagagaagatctgctggtgtcactgtatgagctgaaaggctttgagccaatatgaatttttgtaacgcttgccttccaaccaaagtgagttattaccacaacttacaaaaacatagaccatttcttttaagatagatccatcttacaggataagctgaccacaacttctcatctatcaactgcacactggttaagttggcaagatactttgggaagtgaaagtagctactatatccccaaagtagctataacacagaagggagacgtgtgtgtacacatgcagacactttcaatgagtaataaaacagatttaaaatgatgtttgattgtatttactggagaaatgtagaagtgtattataagaaatctttgtaaacaaaaaaacatttttatagatacacaattttgatacataacaaaaatgtttcatgtagcacaaaatacaatggaaagtgatttgcctgagtttttattacaaagattaattatagaatagagttttacaatacatatttcctaaggaaagtctataattaatattaacttctaaatattatgacttttaaaatattagatgattccaatgataagatgcttaaatatttggctatttaaaaatattttcttggtacgcaacattttactttaagggctatttttttaatgttttaatttgtttttttgttgagacagggttttactctgttgcctaggctggactgcagttgcataatcatggttcactgcagcctccacctcctgggctcaagccatcctcccagctcaaactcccgagcagcgaggactatgggcacatgccacaacaccatgctatttttaaaatgttttgtagagatggggtctagctatgttgctcagactggtctcaaattcctgggctcaagtgatcctccggcctcagtctcccaaagtgctgggattacaggcatgagcccacactcagcaagggcaacttattaataagaatgtggatatgtggacgggcacggtggctcacgcctgtaatcccagcactttgggaggctgaggtgggtggatcacctgaggttaggagtttgagaccagcctgaccaacatggagaaactctgtctctactaaaaatacaaaattaggcacagtggcacatgcctgtaatcccagctgctcgggaggctgaggcaggagaatcgcttgaacctgggaggcagaggttgcggtgagccgagatcgtgtcattgcactccagcctgggcaaaaagagcaaaaaactccgcctccaaaaaaaaaaaaaaaaaaagtggatacgtgatggataaacaacgggaaacataaaaggcaaagtaaaaaataaagttgacttgcctatacaccagtgtttttgcaaatgaaacagtgacttaaaaaatatactgaaaaatgcccagcattattcacatttagaccaataccctgacagagatcatattctaagtttataaggttcatgtcagttttattttgtgcaatacctaacatgttgtaggcattcaataccttttaaagtaagtataattatttttggtcctatggaaattttaggtatgtgtctatgtcccttccagatatttttcactaaatttagcattctttttttttttttaattcatttctctgcagacccaaagctctaagctgaaaagtatttggcaatgatttgcaggcttccaaatattctcattcagtatcaggtaaccattagaaccaataacattttgtaggatattaaaattcttattttctggtatacttccaattgagcacatgtagcaagaaaccaaacggtatttattttacatattaagtccatcttttctacacaaatatccaaattcttttttagagtgaagagaaagaatctatattcatatatgcaagatgattatgagaaaagcgttctgcagatgtctccccacgtttaatcttgctaaccacgatggatctctgcattttcacacagtggccccgcccattcacaaattctcctgagtgagctatttgggggtacaaaagatggaaagcatgacaactggttctatgctcgggctctgaaggcatgtacaagcaagcagtgataataatagatgataacccaaggccatgaactaactctgtccacacagagaactcaaattgatgttaatcggaacctggcacacggatagaggctagggtacgattccttggtttgtagatggaaataaacccatgaagaactttaataaaatgagttctagatggaacacagtgtaatgcagtaatgtagttcttttgctttttttccttcccagctacatctctgtaaaataactctatcaacatttccatgacagcattttaaatctgaggagaaaatgtttcattcttgccttctgtgaactgaaacacatacacactacaaatttaaaaaatcaactcaaagagggggaagggccgttttttctccctcaccgaaatctgttatgttttggccaatctttttgttacctttttccaaatggcattaaatttgtgaacatgaatatgcatttcacctctcctggtaagagaacttggataacacttggcactatagacacaaggtaacactacacgaatattcttgaaacaattttcagttggattacttttcaaatatcaagtccctaatttgtatccccaggcagtgcagaccctggtagcagctcatttcagtgccgattatgcacgcttttctagagaaacacattatctgagccccaggaatatgggaggctttccaaagaagcacagacagtaaggacctttatttgccagctaactttttcccctgtcctctaatttacagctcagggtattaggtaagaaaacaaaggattttcccacacagaaataaactttttgaaaaaccttcaaatgagattttaatgacactatttaccaatatagaatgcatgccgaaataaactgaaacacttctggtggtggatttttctttttccttttttctctttttcccctaatttaactattgcaggcaacatcatagcaatttaagttggttttgtgacaaattattaggacacttattttagaaggaaaatcaaccaataattactgccctggcacacggctattgttcacagcataaacagaagctgtggctgacagctgatgggcccagccccctgctatccttagaacacatttgcagatacccaagcctcttgccagactaagacatgctgtagcaatgcttttcatccaacagagctgcactgaccaggttatgctggctacaacagaatgacaccattttaggacctcctcccaggttggacttagctttagaagctaaaaatactgttataaatactagggattccacttgtataataacattggcctttttgcaccactctaaaatatgaatgtgtaatcccaagtacttgagtgttagatacaagatcccaagtgtttttttagtgtccacagatcatgatgataagaagaaaatgctttcttgtatttgagtaacagaagcatttgggaatgtatgccaggtcacacacatgagattctagatgaatttaatcttagagaattagaaaaggggtctgcaggttattgtgagataagcctttattccataccaaatgtaaagataaagcctctgggatctcaaaagttgagtgatacatgctgcttctttccctccatctttatataacccagtcatagtcactaatttaatgaaaggaaaggtgctttaaagctctctgtagcacctttgttcaattttactgtctgaagttttttggtaacctagacagagtaaaagctgccttttgagatggatctaaaaatgccatgaaagtagatctcctttcagggctgttgtttcagagggaaaaagacaaaagagaaatctaaagggatgggctgcagttaataattaaatatctattagttactccaattcgctacataaatggcctctgggggctgccagagcatctttccaagtcaaagtaaactacagggaaagacaaaaacagtgtttagaaattgcaaaacaacacagttatacttttacttagactggattacatacaaagcattcggtaatatagtcattatttttttaaagggtcaatataaaggttctgccatccttcactacccatcccatgttccaaacagtcaaacagctcccaccagtggtcctgaaccctttagtatatttccacacagttcctttcccttaagaatccccagtctgttctgaatggctaagctttgcctgagaaatcacaacactgtaagggctagtaccgttgcaaattcatgatctacagcctcaactatacccctctgtcatctatcaatcaacctcccacccttcactactctccagcaatcagcactgcactgacctctcacctccaagagatcgatgcttttgcctcctacatcaacagataaaataatgccatcaaacatgaacttgatggcaagtcacatcctattcactgtatacgaatttctaacttagaaaccatttttccctttatcttattcaagaccaattgcttcacttgtgctcttgatccacctcttcgccatgccctaggaaccttggtgcatcaattgtcccatctccctacataatcagcaccttcactctcttcctctttaacagctacttccccttaaaacagggcctttcactactgacattttgggtcagactattctttgttgtagagcctgtcctgtgcattgcaagagattgagcaacatccctggcttctacccaatagataacactaacatcctagctaccagttgtgacaatctaacattatcaaatgtctcctgggaaaacatcctaagttttagcaccaaaactactgactgtatctcaagaaaccacaggatggttggtcaccctagctcagatgcctccaaacatagtcaactaccccctacttggtactgctctattccatttaaatattttaatttctgcacatttcacctagcttataagtgttcatcttctctctcttctgctagactgtgagccaacaaaaggcatgatatgtagtgggtactcctccgatattacaacgctcaccaaggatcatgcttccactaaagtttatggagtaaacgacgagttcataagatttaagcatataccctgtacatatgagcatatttggttaaagccaaaatacaagaaaaagaaatacttatgaattaggcacctacttatgcttttattgacaaagctatataatcattatatatacatgtaagccagtgtaaaaaagatacatacaaagattatattccctctgtcaaattcaaactgccagaaacttaaatgtattttcaatttttcataagcattaagggttataataaagaaaaattacctaagtgaaacaaccaataattatttttggtaaaaaataaacttaatacatgactacagtaattggtttcccttcctatgtatttatttatccttggattttagtcattaggaaggcaatattgttcaagaccattaacttgccagaactgtactagcttctcaagttgaccctaatatgtgatattattagctctttttttctgttagactttccctgtagcatcttcatcaatctttctagcaagattgtttttttcataagaaaaacaatttcacatactaaaacgtaggataataggaattcattcaagattcctaaacataacttgtaaatgtaattggaattagattaacaacaagcaatcaacgattcaaaaaaattaaatagttaaaaaaataggaaagatgagaggatagtcttcacaaagtggcaatccagcctagttgataaagtactcaactctctggttatccaaaaagacatggaaggtttcctatgtaagcaggtttcacatgtgatacttctctaaggcacctaaataatcaacaaatacaacttctgctttcctcccctgcctctttggggaaatgtgttttataattgtaagtagaattcatagtttgatcgcagaaaggctgatgtgtcttgttttgtggccagaatttattgtaacttaggggttaaaaagagcaaagctgcaacaacataatttgtttttaaattcacagtggtccttcacccctgaataataaaaagcattttctggaaatagtgtgcctcattttaccaactttagatctttaacatctgaacttcaaattttaaacaacaatatgaatatgaaggtgtgtatagaaaaacataaaggagatttaaacataaagctttgaaaaagtcagtaattaatgaacaaatatatttcaatcaccagcagagcccctggaaatgccacatatatgaactttttcacaatctttctattttttatattccctagagcatgactctctcaaccattcccacttgctttttttttttttctttttttaatatctccttcacccttttcttttatattactgtatctttggcagcacttgcttattcttacttctggtctttccaaactcacccaaaccattaaatagacagtgctatccaagaaacgtgcagttgcaatcaggccatgaccttgttcgagaatcttccatggttcgctactattgcctacttagtgcagaagagaaagtcctgttcaaagaatttgctaaacctatcagacaagactttttacatctctaatttacccgagatagcatcaactctcactattcataaacaaatcagactcctagccttttatgaaaaaaacattttttaacatttttatttcaaaatactgcccaacagccccccacaactgaatcacctgttgttacttgttaaagatgcatattctctgagaccagatcctgaatcagaatggcacagtaaggcctgggaatttgtgtcacaaatgtctcctccagatgatcttttagcatactaaaattttacaacctttttgtgtatttgttaagactattccattattcaaaaatattttcactaaaacacctgcttcttgaaagctgattccactttcagagccatctcaaatgccttctcctgggtgaaatcttttctaatccccaatcgaatatcatttctaagggctctgaactcatgtatcactgtttggcctctctcatggccagaagtagatttaccttgaccttaggaagcttcagcttcaggaccctttccttgcataggtaccacacgtcacactggcatggtcaaatacattatacaatttgtaatagtgaggtatttccctcccaagcatttgaaggccactcttatttaccttcacacacagtggtgttagaaagctacaggaaattttgcagggtccagctagggaagctgaattgaaatatatttgttttggatttagcagaatatctttatatggttcacagttaaattattactggccttccggtataggaaaggtttctgggaatactccctactgctcactttattaactcatccagttccttagatgaggatgtcagtgacaaactagctgatatgtcataaattcaaagagtgttacaacctgtcactgtacaagaaaactggaacaccctgaaatcacatagctttacatcacagaaattatcacattaccaatagtaagttgtaaagatgaaagtttatgaattattaattttaagaaatataaacttaataattaccaatctgactggcgagggatggtagctcattatggttttgatttgcatttctctaatgatcagtgatgcagagcttttctttcatatgtttgttggtcacatgtatgtcttcttttgagaagtgtctgttcatgtcttttgcccacttttttttttttttttttttgagacagagtttcactcttgctgcccaggctggagtgcaatggtgcaatcttggctcactgcaacctctgcctcccgggttcaagtgattctcttgcctcagcctcctgagtagctggaattacaggcacccaccaccatacccacctaattttttgtacttttagtagagacagggtttcactatgttggccaggctggtctcgaactcctgacctcaggctattcacccaccttggccccccaaagtgctgggattacaggcgtgagccaccgtgcccggcctgcccactttttaatagtggttttttcttcttgtaaatttgtttaatttccttgtagagtctggatattagatatctgtcagatgaatacgttgaaaaaattttctcccgttctgtaggttatccgttcagtctggataatagtttcttttgctgtgctctttagtttaattagatcccattcatcaatttttgcttttgttgcaattgtttttggggtattcatcatgaaatctttgcccgtgcctatgtcctgaatggtactaaggaaagcatacattttactaagtctaagttttatatcctctgcagaaattggcacatgggttttttttaaaggcacacagtagtctctcactaaaagtctatctaactaaactgacttatttccatgatcataacaatttagatttcatttcaaattatttcttataataatgttttacatccttttgtaatactttataataaattatcaaattattttttctggatttcacaaatttatttgggcttggccaaaaatcttagcagcaaaatattgcttgtctttttaattaatgatgtacagagaatatgctttgttcttttatctctccccgaaataactgaattgagagaataatgcagaaaatgtagaagttaaactgattcttttcagcttatttggaccctaacatgttgcctaattacaatagcagtgaacacccacagataacatgtataacagattttatgggaattaaaggagctctataaaggactgatgttttcttaagcctattattatggaagtttatatgtaaatagcaatttaatttttaaaatccttactactagttgcaataaatgttcaatatttggtaaattaacaagtgctatatgagaaccactgtgagtccctctcagaactcacattgtgtcctattaaattgttctgacctttcccattaaggcaatttttcccacaaaggacatattgagagcttcaatgagcagtttttaataagttaactatcaagaaagatatttttctattagtaccagtagccaatatgtctatttttaaaaaatgatttcagtatttcctccaagaggactagattctctcatacgtatcctcagagatccacaaaataatatgaatttggccccataattagttttgcaattttgtgcagcatctagataaaagcacatttggaaaaaaaaaaaaaaaaaggtgaagacaagtcagaaattctcctttttttgtcctttttttgtatctagatggaaacactaccctagctacaaaggatgaggcggtatctatttctaccattgtagagtatttccttcaagaaggctggaatactacatttccttgatacggaatccctgatatataaaatgaccaacataaataaatacaattgcaatggatatctagacaattaactaaaatgctaatgaggctccaaaatccagctttagtgccaatttttacatagcatctcctctaatcgttcatgattatatttttgccgcaggccctttgcttccttcatccttaggaagccttgaacttattctcatccttcaacaatgtcaaaagaagtaactggaaaaaaaaaaagtgacaaaatcaagaaggacactgtgccattcctttgaagcagaacatttctgaatgagaggggcatgataattatgcctctcagatgcatatccacatttttgctagccatggtccttgaggatttggagacatttttaaaatgaatttcttcaagtgaatgctgagacactttggctgcaagaatctcaggagactgtgttggccagatggtggctaccatgccagagaagtcacaaaatgttccagctgaaaactgatttaagacaaggcaacaattccatattttatgagccaaaatattacactatcccatcaagagtcctccagattccaacctgttgttatcaccatgaccatcagtattttcaaatactactactaaataaaaaccagtcaagaggaaaggtttctaaccctctccatccaggaatatatctttgaaggtttctatcacttctaacttattttacaccatgttctgaagtaacaagctatctaaagtttaaataccagtagagtggattcccatctgtggggtcttggaccaagaagagggtacagaagtaattgattggggcaaatagaaaaggaaggaaatccttaaagcaaatatggggctgttcacagccatttcatcattttacagggatctgtttgagaataaagaaggattccaaatttaaaaattttctacctatggttttagatgtcactacaattaatatcaacgttctctaaattattagaatcattcctcttcaatgatgatatttgatctagagaaagaatattatcatggcagtgtaaaggaattattcaccaatgaagaataaatgtagagagagagagagagactggttcaaaagataatgcaatatcatacctattataagaaaaagaattgttcaaaacaacttcatccaaattggtggagacaccctctgttcctcaggtacaaaaatgtgtaacatagtcattaccacttcctaatgaattgcaaatgtgtttttcagaaattattttcccaaaaagcaaacatacccacctcagtttccccaaatattaaccacatttggttgaaatctttctgaaatatagcatgtacatgctcttgtcttacacaggcacatatcctatagaagaatcaataatctaagctaagcaataatagccatacacgtaacagggatttattttttaccatcacaaatatttaaaggttataggacttgcatgtattatttgttttccttttccgcttttgattctgtgtggctccgttcgtaacagtgctttgagggttaagcccactggtggcagatgactgggtcagatgcattcaaaaagataacacttatccaaattagttggagtcataaaaaacactgtttctcacattcctgtctcctattactgagtctgctttattggttactgatctttggctcccattttcagttatgcctccaggatcctccccagctggctcccagcccctcagtgaacttctccttttgaccctggcagactgccatgattccacctctgaaaccacaaactaaactggacttgttctttcttctgcaatgacttcacatactctgcatttggtcctgctaagccctatattgtatcaggcagagcaatcaaaaagcaaacctcaaagaagtaaggttttatatacaaggactcttgactttccacttactctttacctttttaaatttcattccttccatcaacttacaggaccttccacaacctgacagttgtcctggatagcagtaacagtgagcaatatgactccctaaaaactaaccttcatatggcatctcagacctcagaaaatcacatgagatttatcatttaactgagacacacacacacacaaacacttgcactcactctggctatgaaagagcttgtatcatttcccttttgcagatgatgaatctgaggcttattgttctcaaaatcagacatttttctggttatagaacagtcccaagttcagatattgtatctataaataccctgctctttttcatatgccagacccttacaagctgaagagacaaaaatgctctggacataaagatctacctggcctgaggacactaaaaagaatcaaaccttattataatggtcagagaaaatcctaaaggagaaatcgcctcttcatcatggtcaatacacagttcagcccaggaatatgattcactgttctaaattgcattgtcaagtattcaaaatcagtctcttatttctcattaccaattatagcagaaggttgtatttatagtgggggcatttccacatctagtatcaaggcagtactatgcctgacatatagaaaaaatgactttgtattccaaagggaaattttaatgtctaggaacaataaaagtgttagaatataaaatgtttacaaagaaataaaaagttcactttaaaagtttaacacaggtaagaatagctgtaattttacaacacttgttccttttcactaacgtttaaaaattttgtgcatgaaagcagaaaacaaaaaattgcaataccatcagcaattatattctactattactctgccatatgctgagaaaagcaagataagaatgttgatttatactttcacagttatttctgtgtttgtgttttatttctccaaccattgacacttattgagtgcttgtgacctatgcagttatagtaaagtaaaaatgaaaaatctcctcctggttaattctaaaacttcatagcattttgtacatttcactaaatattgaaagggacagctaattaagtatttggtctacaacacggatctatttatttatttatttacccattcattcattcattcactcattcattctacaggtaaagccttgctacgttgcccaggctggtcttaaacctccgggttcaagtgatcttctaccctcagcctcctgagtggctgggactccatatgcataccaccagagccaacttttttttgttttgtttttcatagagcttttcaaaacctacagaagaacaataacttatgaggatttgatgtattttacataagtgagagacaaccaagtcacaactgcatgtttaattacataaatgtatatgaagagcaccgaggttcaaactctcaaaaggaagatcaaaatcggtccctacatttgttactggggaaacggggtcactgctatgttggaaaacaaacaaacaaacaaacaaacaaacaaaggtcagactccaagaacaggatgacaagagaatgcttgaggaagaacaccaatcttgggatcaagagacaaggaagcatctctgctgctggttatgttcatggtatggtctgggtacaacagggaagagatgacatacaactatagtctatctgtagcccacacctgttgtctaattgtagacaactcttcagggctctgatacagcctaggaaaaatggaaattttcatcctctggcttttctccaacctccaaacctaaccctcacaagggtttcacttcctacttgttcatcccagtagcatagactcaccaattcaccataggccccaatactccctactgcctttccctcaaatcaggaccattttttcacttttatctggaccctgtaagcatctgaatttgtgattctcaaacttttatcccgtactaaaatggatattttttttccattttgcaaattcatttctgaaaacaactgttttaaattttggttctgtggcacacacatttacctttttatgatgattatcttaaaggaaacctctttctacatatgtatataaaagttaaatgctaagcatattatctaaagtcagtagagacacaccagggaaggaattcctggtgtctggaatatacaaataaaaaggttttgttttcatacacttggataactctaaacttctcagaataattagtctgttagcaatgataaaacctggtataaaaagtcaaatactttttattttatcaaataaaaactatttggaattgagcttttgaaactgactcttccaactggtcttttgattgaaagctaattttttaaataatatacttcttataatgaggagaatatttttcaaacatgtttgaggaatggaacacccaagaatcttgttttttttctttccaaaacgaaactagtattgagataattggctttttttttttttaattctgggtccacaaggtaaaagactcacaaggaaaaagctactattaagaaaattaaaattttggttaactttttatttaccaaactaaaaaaaaaaatatcactgtcactgaatgttaggtgggaaattttgttctgcatgtgattgtaaaagcatagctgtgattgaggattttaatagtgtatttttgttgttgttatttatttattgggaggcagtctcactctgttgcccaggctggagtgcagtggtgcgatcttggctcactgcaacctacgccttctgggttcaagtgattctcctgcctcagcctccccaagtagctggggttacaggcacctaccaccacacccggctaatttttgtattttattagagatggagttttaccatgttggtcaggctggtctccaactcctgacctcaaatgatctgcccgcctcggcctcccaaaatgttgggattacaggtgtgagccactgtgcccagcctttaatagtatatttgaaacatgatggtactatatttgcttaaatgaaatcacaaaaatgattaattaaagtgtagatattaccaattaagtcttcaaagtgcattaaaaaaaaaaaagcaagcttaaataattggcggaaaatgttttttaaatcactgtgtttcccaagacgatctctgatatttcacactgcttacagatctttccggatgtcatggaaaaatatttcctgcagtcttttcattatctctaccatgtcgagaggatattaacttttattttaaccaacatcatctggagactgaacactacaacacagtgcaaaaccaattggctcttcatcctctccaaactttcactagaaacttgaagatatgcaaacgtttacacctatcatcaaataaatccattcaagattcatatcagaatcttctcttaataagcctttaaaaaaatgaccaagcatcatattccttctcatttctcatcaccatcatgtgtatctatcaactcttctgaatcatattaaccgtgaccatcaaggttcaaaattttcttagtgaatacggacattttcctatagagaacacaagtgtgtagatgctgccaatcttttcttcaataaaggcaaattgttgtttaagcactatgggtacaaatacaaggcaagcacccatccctgatatcaaactgcacaccaagaagcatggaaaaacaagcctttatatagtactccctccaatgtgatagatcagccaagtggcatgaaagttacacctgccagtcaatctatactttcctagtgagcagagaccaccagctcatatacttccagatagctctggtgtttatggtatataatcctcttaaatgcatgtttgctgagacacagtaatgactcacattgtatatatccccacactacactattcctgcatacagccagaagctgctttaaaatatttccccagtcatattcatatacaaagataaataaatttttcagtttttcaccaagttttaaatgcaatctcttgagtcccatggttttatcacagaaaggtacacttcagcttaagaagggaagaattaaccattcaacttctaacaataacagtacactgaagacctaattcaattggcacagtctgggaaatgttcaccaactacacacaattgagtgatagaatgcaaaatacttcatgctttcttagcagaacactaaaatctatcagagaatgcaccttgattttgtcaaactacagcaataaaagtaaagcagcaaaaaaaaaatatgttcgctcattctcaaaaactgagttcgaatttttttggagggagggtgtggttctttcacaagcagtttttaatcaaaagtaagattttgtttatttgtttcaaatgtgtcaaattgctatgaaaaacagaaacaaatattaagctagccattgtgtccccacgaaaatgcagcaggtcttaatactctcccagctgttctgacaaccactgtaggcagcccttcccctctgtagacttggctgcattgcactggggagtagcatgatgtccacttgaaactgtattatctggagcttgcttttaatgtaattacttcaaaacagagaaaagaattaaaaggcagggttttttgtttttgttttccatgagctgatcctttgaacagctactgagaggaggacagcttacctgaattagaaagaaaagctcaactgttaagtcacttaccctaattaaagatcaatacagatattattagacattcattctacccatctaatccagagttgtgatgttacttttcataatacctgtatacacttactgccaaatctgttttcctgcttttcctattgtctttttctctattatttcccttcaccccacttttatttctcttcacagaaatgcccctgcatgacacatagtaacaaaagtcacagtccctttgcaagaaggaagaagcttgaatttaagcagttcttttaaaaattcaatatccaaagaaatactttactgtaacagtgtcattgctactccttagacttgttattatgtttgtgaaagttaattatctgataagatacactgtggttactactgtcacaaaaaaatgcatgggtatgtttattaattcaaagtgttccaatgaaataaagtgtgttaactaaagaactgaacaattatttccccgtaattattactgcacatttaggcgtttcataactgttttttttttttctgaatgaaaatcactttatatttaaaactatcagcatttacagctttgtattgtaaaagaatatgctattttgtccatatttttatactaaaggcccaggttgaaaaatccaacaatttaaattgaagatttttttcccctgctgtagaaaagtgtcaacatttgagcaaatcattaaacatactagaacaagaacctacaactaaaatgctgattatgattcatttcaaatattttaagtgttaagtcaacattcaatgcaggataaaatgaaatggtttgttcagaaggaatagttagagatctgcttactattctttctatttctgttattttcctgggataatccataaaaatcttatgtgaaagggaaaaaaagagaagatagtttaaaaatgaaagccataatctgaatggaattc

SEQ ID NO: 82 - DNA, 167253 bp, Homo sapiens
gaattcataaccaagttctcaaaaaaaaaactgcaacaaaaataaatattgaccagtaggacttaaactaaagaacttctgcacggcaaaagaacctgttagcaaagtaaatagataacctacagaatggtataaaatattcataaactatgcatcaaacaaaagtctgatatccagagtatctaaggagcttaaacaattgaacaagcaaaaaacaaataatcctattaaaaagtgagcaaaagacatgagaaaactcatctcaaaagaggatatacaaggggccaacaaacaggaaaaaatgctcaacatcactaatcatctgagaatgcaaatcaaaacacactgagataccatctcacaccagtcagaagggctattattaaaaactcaaaaatcaacagatgttggtgaggctgtgcagaaaagggaatgcttatggctgtcgatgggaatgtaaattagttcaaccactgtggaaagcagtttggagatttctcaaagaacttaaaactaccattcaacacagcaatctcattactaggtatatatccaacagaaaataagtttttcgacgaaaaagacacatacacttatgtcttcactgtagcactattcacaatagcaaagacatggaatcaacctggatgcccatcaatggtagtatgcatataccatggaatactatgcagtcataaaaaaaaacaaaatcatgtcctctgcagccacatggagtggctggaggccattatcctaagtgaattaatacaggaatagagagccaaatactgcatatttttactcaaaaataggaggtaaatattgggcactcatggacataagaacagcagcaatagacactgggaaccctattggtggaagtaggagaagggggcaaggattgaaaaactattggatactatgttactacctgggtgatgggataaattgtaccccaaaccccagtatcacgcaatatacccatgtagcaaacctgcccatgtactccagaatctaaaataaaatttggaatttaataataataacaataataaaatattaacctctcctccccaccaaaaaagaaaagtggatctctaggtagcttccctttgagtcaagtgggttagagtcacaaaatcaccagatatctaggcatcagcttccctgggctgcagactagcccaaacactcacaatgtagtacctgccctcatgaatcctattccctagagaaaaagtcagactttaaacactttattactgtagacacagtgcaatggaagtgggaaggagaaaacagctatgtttagtggaatgagatgagatgaggaagaggaagagatttacaggggaagcaataagtaaagtttctgagcatgcaacattcactagaaagataagcagaaggcaggattcatggcacagaccacaccacaatagaggtaaggtgggatgaagtgtgagcctccatgcttagaaaccaagtgactgcagcttggtaagcaggtggggaaagagtgacaattgaggctggacaggaaccagatcacaaaccatagtactgtgagagctaaagataagatataataaatctaacaattttaaagtgtttccaaaaattatcaagcacacagaaatgctagttaacccacaaaaaatgtaccttcgttaaaatcacatcgctgaatgagacttttctcattcaccatttaactacttagaaaaatggttgtaatatcatcacaccagttaaaatggcaatcattaaaaagtcaggaaactacagatgctggagaggatgtggagaaatagaaacacttttacattgttggtgggagtgtaaattagttcaaccattgtacaagacagtgtggtgattcctcaaggatccagaaccagaaataccatttgacccagtaatcccattactgggtgtatacccaaaggattataaatcatgctactataaagacacatgcaagtgtatgtttattatggcactatttacaatagcaaagactcggaaccaacccaaatgtccgtcagcaatagactgggtaaagaaaatatggcacatatacaccacagaacactatgcagccataaaaatggatgagttcatgtcctttgcagggacatggatgaagctggaaaccatcattctcagcaaactaacacaggaacagaaaaccaaacactgcatgttctcactcataagtgggagtcgaacaatgagaacacatggacacagggaggggaacatcacacactggggcctgttgggagctggggggaaaggggagggatagcattagaagaaatacctaatgtagatgacaggttgatgggtgcaggaaaccaccatggcacgtgaatacttatgtaacaaacctgcatgttctgcacatgtatcccagaacttaaagtataacaaaaaataaataaaataaaataaatggttgtaatatctatccctgggacctcctagttctcaaggatccaaagatgtacctttggcaaagatattccaacttttcctctgacacagaaacccatgaaataaatgattcagtagaacttcatcaaagaagagcaggaaaatgtcccttgatcaggagattgattaaatatgttagggtacatttttaaatgtcatactcattgcagttaaaatgaatgagaggctctttacacacttttgcaaagatgatcaaaataacttgctaaatgaagaggtagattgaagaatactaagtgcagtggaaatataccaaaatattattatagctttctcaaaggagtatgatggaatatatatatgtgtatatatatatataaaatataagctcattgtgaaaacaaaacaaaaatatataaagtgaaaaatgaaatttctgtctattttttttttttgagacagagtctcgctgttgcccaggctggagtgcagtggtgcattcttggctcactgcaagctccggctcccaggttcacaccattctcctgcctcagcctcccgagtagctgggactacaggtgcccgccaccatgcccggctaattttgttttttttgtatttttattagagacggggtttcaccgtgttagccaggatggtcttggtctcctgacctcgtgatctgcccgccttggcctcccaaagtgctgggattacaggcgtgagccagcgcacctggccgagcttatattattttgtattttaagtctccccccaggaaaaccacaacagacaaatggaataggaaggagaagcaggaaggatcaaggtgagatattcacaaaaaccttctgcttgaaattcttttttttaaaattgcattattaatatactttaaattttagggtacatgtgcacaatgtgcaggtttgttacatatgtatacatgtgccatgttggtgtgctgtacccattaactcatgatttagcattaggtatatctcctaatgctatccctcccccctccccccaccccacaacaggccctggtgtgtgatgttccccttcctgtgtccatgtgttctcattgttcaattcccaccaatgagtgagaacatgcggtgtttggttttttgtccttgtgagagtttgctgagaatgatggtttccagtttcatccatgtccctacaaaggacatgaactcatcattttttgtggctgcatagtattccatggtgtatatgtctatccagtctatcattgttggacatttaggttggttccaagtctttgctattgtgaatagtgccgctataaacatacgggtgcaagtgtctttatagcagcatgatttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtgtcctatttaatgatcgccattctaactggtatgagatggtatctcattgtggttttgatttgcatttctctgatggctagtgacggtgagcattttctcatgtgttttttggctgcataagtgtcttcttttgagaagtgtctgttcatatcttttgcccacttgttgatggggttgtttgtttatttcttgtaaatttgtttgagttcattgtagattctggatattagccgtttgtcagatgagtaggttgcaaacattttctcccattttgtaggttgcctgttcactctgatggtagtttcttttgctgtgcagaagctctttagtttaattagatcccatttgtcaattttggcttttgttgccattgcttttcgtgttttagacatgaagtccttgtccatacctatgtcctgaatggtattgcctaggttttcttctagggtttttatggttttaggtctaacgtgtaagtctgtaatccatcttgaagtaatttttgtataaggtgtaaggcagggatccagtttcagctttctacatatggctagccaattttcccagcaccatttattaaatagggaatcctttccccattgcttgtttttctcaggtttgtcaaagatcagatagttgtagatatgcagcactacttctgagggctctgttctgttccattggtctatatctctgttttggtaccagtaccatgctgttttggttactgtcgccttgtagtatagtttgaagtcaggtagcatgatgcctccagctttgttcttttggcttcggattgacttggcgatgtgggctctttttggttccatatgaactttaaagtagttttttccaattctgtgaagaaagtcattggtagcttgatggggatggcattgaatctataaatgaccttgggcagtatggccattttcacgatattgatttttcctacccatgagcatggaatgttcttccatttgtttgtatcttcttttatttccttgagcagtggtttgtagttctccttgaagaggtccttcacatcccttgtaagttggattcctaggtattttattctctttgaggcaattgtgaatgggagttcactcatgatttgtctgttattggtgtataagaatgcttgtgatttttgtacattgattttgtatcctgagactttgctgaagttgcttatcagcttgaggagattttgggctgagacgatggggttttctagatatacaatcatgtcatctgcaaacagggacaatttgacttcctcttttcctaattgaacaccctttatttccttcttgtgcctgattgccctggccagaacttccaacactatgttgaataggtggtgagagagggcattcctgtcttgtgccagttttcaaagggaatgcttccagtttttgcccattcagtatgatattggctgtgggtttgtcatagatagctcttattattttgagatatgtcccttcaatacctaatttattgagactttttagtatgaagggttgttgaattttgtcaaaggccttttctgcttttattgagataatcatgtggtttttgtctttggttctgtttatatgctggattacacttactgatcttcatatgttgaaccagccttgcatcccagggatgaagcccacttgatcatggtggatatgctttttgatgtgctgctggattcggttgccagtattttattgaggatttttgcatcaaggttcatcaaggatattggtctaaagttctcttttttggttgtgtctctaccaggctttggtatcaggatgatgctggcctcataaaatgagttagggaggattccctctttttctattgattggaatagtttcacaaggaatggtaccagctcctctttgtacctctggtagaattcggctgtgaatccatctggtcctggactttttttggttggtaagctattgattattgcctcaatttcagagtctgttattggtctattcagagattcaacttcttcctggtttagtcttgggaggatgtatgtgttgagtaatttatccatttcttctagattttctagtttatttgcgtagaggtgtttataatattctctgatggtagtttgtatttctgtgggattggtggtgatattccccttatcattttttatcacgtctagttgattcttctctcttttcttctttattaatcttgctagcagtctatcaattttgttgatcttttcaataaaccagctcctggattcagtaattttttgaagggttttttgtgtctctatttcctttagttcttctctgatcttagttatttcctgccttctgctagcttttgaatgtgtttgctgttggttttccagttcttttaattgtgatgttagggtgtcaattttagatctttcctgctttctcttgtgagcatttagtgctataaattcccctctatacactgctttgaatgtgtcccagagattctggtatgttgtgtctttgttctcgttggtttcaaagaacatctttatttctgccttcatttcattatgtacccagtagtcattgaggagcaggttgttcagtttccatgtagttgagcggttttgagtgagtttcttaatcctgagttctagtttgattgcactgtggtctgagagacagtttgttataatttctgttcttttacatttgctgaggagtgctttacttccaggtatgtggtcaattttggagtaggtgtggtgtggtgctgaaaagagtgtatattctgttgatttgggttggagagttctgtagatgtctattaggtccacttggtgcagagctgagttcaattcatgggtattcttgttaactttctgtctcgttgatctgtctaatgttgacagtggggtgttaaagtctcccattattattgtgtgggagtctaagtctctttgtaggtctctaaggacttgctttatgaatctgggtgctcctgtattgggtgcatatatatttaggatagttagctcttcttgttgaattgatccctttaccattatgtaatggccttctttttctcttttgatctttgttggtttaaagtctgttttatccaagactaggattgcaacccctgcctttttttgttttccatttaattggtagatcttcctccaccccttaattttgagcctatgtgtgtctctgcacatgagatgtgtttcctgaatacagcacactgatgggtcttgactctttatccaatttgccagtctgtgtcttttaattggagcatgtagcccatttacatttaaggttagtattgttatgtatgaatttgatcctgtcattatgatgttagctggttattttgctcgttagttgatgcagtttcttcctagccttgatggtctttacaatttggcatgtttttgcactggctggtaccggtttttcctttccatgtttagtgcttccttcaggagctgttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggtccccactctcttctggcttgtagagtttctgccgagagagcacctgttagtttgatgggcttccctttgtgggcaacccgacctttctctctggctgtccttaacattttttccttcatttcaactttggtgaatctgacaattatgtatcttggagttgctcttctcgaggcgtatctttgtggcgttctccgtatttcctgaatctgaattttggcctgccttactagattggggaagttctcctggataatatcctgcagagtgctttccaacttggttccattctccctgtcactttcaggtatgccaatcagacatagatttggtcttttcacctagtcccgtgtttcttggaggctttgttcatttctttttattcttttttctctaaacttctcttctcgcttcatttcattcatttcgtcttccatcactgacaccctttcttctagttgatcacattggctactgaggcttctgcattcgtcacgtagctctcatgccttggttttcagctccatcaggtcctttaaggacttctctgcgttggttattctagttatccattcgtctaattttttttcaaaccttttaacttctttgccattggttcaaatttcctcctgtagctcggagtagtttgatcatctgaagccttcttctctcagcttgtcaaagtcattctccatccagctttgttccgttgctggtgaggagctgcgttccattggaggaggagaggcgctctgagttttagagtttccagtttttctgctctgtttttttcccatctttgtggttttatctacctttggtctttgatgatggtgatgtacagatgggtttttggtgtggatgtcctttctgcttgttagttttccttctaacagacatgaccctcagctgcaggtctgttggagtttgctagaggtccactccagaccctgtttgcctgggtatcagcagcagtggctgcagaacagtggatattggtgaacttcaaatgctgctgcctgactgttcctctggaagttttgtctcagaggagtacccggccatgtgaggtgtcagtccacccctactggggggtgcctcccaattaggctacttgggggtcagggacccacttgagaaggcagtctgccctttctcagatctcaagctgcatgctaggagaaccactactctcttcaaagctcagttggaaatgcagaaatcacccatcttctgtgtcgctcacgctgggagctgtagactggagctgttcctattcggccatcttggctcctccttccctgcttgaaattcttttgatgccattatctcaatcaatcattaggcaaattgcttggttaattattttttattgacttgatgtaatgcttggctaaactgatccaattgcctggttgttttggatccagagtaatagaacccacgttgttttttgtttgttttcttttgccccccccccccactttattttctttttctaggtttctcttcatccattttcctgtcataggacttcactgatagaaagaagactgctcagtttttgaatttatgtttcgaagaattaattggggtgggtatgtggggataggtgctgaggtcctgtggatctgtgaagtgttaaagggtaggatggggaagaacaaagatttcctgagtgtttagtgtgagttactacgttggtgcaaaagtaattgctgtttggggcattgaaagtaatgtccaataataaattactttataaacattctccaaattaaccttcctagcacactttgaggggcatatttttgcttctgttttaaaaataaagagggattaaataactaatatggtacctagtaaatgacggttttcaagattttaaaataggtctgtctagatgaaaacacataggcacacaatgctaccagtatgaaaactgattctaaagagattaataatgtgtatcagcctaagatgtttcaatggttgaatgacttaggacaggaaaggatgtccttggaaatatagtaaaaaggctgcaaaaaatgtgtccagtcttatcctccacccaagtctgccccacctttactccattgactgtttcaggtatgacatgaaattatgtctcaaactgcattagaatggactgtgtaatgcatagatattaatattttggtcttggattttcagtacaagcctctctacctcccataagcctcacaggcaactgcaggttgcatccttaaggacctgcattagatgaccatgtctttgtttctctgattctcttgtttcatttgtctccttttaatatttgcagccaatttgagtttgaaatggttagattcactgcagaggttaaagaacaattttgtttactcttaattcacatgaaccccttagcagagttagttatctcaggcctcaggccttgctccaggaaagaaatcagagattgtttccagtctctgaaaaccacaaagccacagatatgatgatatccctccacccttttatttatccttgtatccaaccatcagtaactgagaaaggctccaaactgttgtcagtggttaaaacttttcaattagagtgggggaatttcttgggaggaagggatttgaattcacatggagtaaaagaggctagaaaccctttaggactctgggaacagtaagtgtgctgcgatcatatttgagtttcaagtctggtaagacccagtcataccaatgttagtaatatctatcaagtttctaaatttatataattttttgaagctggacatagggaagaatccaggcagaattcccttagatgttaaacaagataaaagaagcacacgcaacgggatctcccaagataatcatctgtaaataaaatggaaaattatagtggcaggctgatttctcctctctctcttggaaatacaaggtttactccattctctgtcactaaaagaaatacaaggagaagagaattttatttttttttcttctctgtatgtaagtctaatccatgttattcctttggagctttgctagagatgcccacgtcttttgtttcgttgttcagctggatagttagtctttgacccagatgagtcttttcctttttctaagttattctggccttctcataaacccaaagctactggagaaagtgaatagcttaagtagcttgtaatgtattttttagaaaatattttataaaaccttggcagcacaggacttgaaattgaaaactatttcaacatcctggcgtgttctattttcaatagtcaggaagcctttctcttgctttgtcaggatgcatttgtgccctttagatgttcgattcaattcatctccatgctgtacttttgtaattggtatctaagaattttctaaaacattttacatgtgtgttcttattctattgaagttctgttttgaatggttttaactgtattccctaagcagacagacggggcaggagttctttaccagggaaagaacatgatcatttcaacctgatgactttaagtgagtaagaaaaaaaaataatcatcataagaaggaaatgcaccatgcactggtaggcaatgcatctaaaaaccataaccacttccgcattgctcaatctgtaagttggtgcagaatctctatacagatcaatattgctgggcttataacacattgagaatggagatatcctagctcagtcagccatgtgttctttctaagcagtaaagaaagcagcccttatagctgcatgtccaatgccttaaacatttactgaaatggaatggaaacagccaggcccaggacatttagagcagtcaaatcagaatgcaaaaaccttttgaagtctgaaataatgtagaaagtcatcagaatagcaaggtttgaatggaacaaggtacatcattatcagaaagaaaaaaccatagtgcacacaacatcaatatgtataaatttatctctaaatcttatatgtgccctactaaaccagtaaattatgtactatcaaataaatttaaaaggataacaaaaatacaaatatatataaatgcctacattttcttcccaatggaacactttgagcaaccccctggatgaatgtactttaacttattgtcccctggtgtaaaggatccctttttgctcaattagagcacttcctctgggtttctagacagttctaccattaaccatatcactgagttaagagggtattgaaatctatggctcatgtaaacatgactccttggacaggtaaaaggttaagctattaaaccatcttcatgaatttgttttgccagctaaaagcagcccctgaaaaagggagatttatctcagatatctgaattcaaaatatccaaagccaaagagcacaggtttgagggcctgattactgtatcagggaaccctgggtggcttttgtcccttggctctcagataagagggtataaatgcagaagcatagaaagcccacatgttgaggaagattatcaaacatctgtgtcttgccagagctcagtccttccctgtcagtgaagccacatgatttctctgcatgcctcccttctagaaaatagccaatatggcttcaaggaaatcctgacttctcacatcaaagcctttagccctcaccttcctaaaaccaccacaacagttcctaatggctccatgtcccgccttctgtggaggagtggaggcgactaagtgacagggaaggattagaagatctcatgcctttcactctttaagaggatggatgcattttgagtttccttctttcaaaaggaactcagatgtttgagtttgaaatcttataatagatggtgtaattttagctcacttcttttttccatcaggttaaaaataactttcaaataattttcttctcattggattttctcagtcacagattacctcaaactcacatttggaacccttattagttgatagtgccttattactattaatcatgttctttgatatatattaaatttgacttgatttattgggagattgatactggtgaccttagaatgaacaaaaattattatgatatttaatactaaagcctgatcatcatgcaagctgcatattaataacctggtagatttgaggacgcatttggaactgaaatgttagggatttttcttttcattttcctgaactattacggaaaagctccatagagatacctatgacagaccactaaaacatgtcaccaaaacatcttaatgttccctgtagaatgcaagaggtcaggggtataggttggaaaggcactctggacattcctgggaaagtgatgcaacttcattttattgcttgagcaattcctgttcaatgaatcaaacattatttgggcgcttaatatgtactgagtactctgttaggagctggatacataaatgaataaggttggttgcttgccctggaagagctcacattctggcatgagagagacacataccagataaattctgaacaagtacagggagagtgttatgagaccccaaaaagcattgctcaacctagcatggcaaagagttaggagtttatctgggaaaagatagccagtgagggaactgggacttactggagagtgaggctgaaggaagtatattaaggacacagaacttgaaacaatcaccacacatctccaaaacataagttcctttcctcttggttctcctattggccagcaatggagaaacataaatggtgcaagagcttacctgggagtgtgaggggttcccagattcaggatcagcttgtcagaataagcattatattgtagtctcccactgtcaccaacagatcaggcccaagccagatctaatagtctggacttagcattattgaaaaggtccagagaagagagtgcaatttccttcctcaaagttcaccctttacccccacttcagacaatgtacggtcctcaccttaggtacatgtgcatccatatcccagcttcaaaggaggccctgaaacattttagtgctctttcctcccttcactgaatcttctacaggataccttcacacagtacaagctatgcttttccatttgcccattccagttcctctttgtttctctctttactcctaagaacagatcactcatttatcatctttatttaaatgttcaggtagtatgcacactagaccatatttctcattcattttcaaattttacattctgagataagaggtttcaagaccaggatgggccagaactttataaacatcctggtcttcattttaaaatttaaaattccaaatgatttggagtcatataactcagctttttaagttagatttagatactcctttttacccttaggagtgctgagacatttagtattaattaaagtgtattaagatcccctcactttgcagaattttttgacagtgagaaaattagagatactccatggtgttgaaaacctgagaattcaacccaacattgcctgataagtcttagagttgggctggcagattttggcagcttctctatcagcaagatttgtatgtcagggagaacagtgaaagaggtctgggagcatcagaggagttggcctttttttcacagcatggcattcacctttagagcacctcataaggtcaccaatgggttcatgctatgattctcatctagaagcttgtgacttaaagcctgaggtattttctcaaagataaacaaatataatccaatgggagaaaagtggaaatatcttgtatttatttgtgtaatttttagtatcagcaccttcataaaagcactgttagactgtgcttctagaagaaagttattggatcattgagattgagtctacgatgtacattctgtcctcaaagattagtccaaggcaatcatgtggctcagagtctccttgccaacaattggtttagatataaggatattatctagtcttggccagtaagacatgaagtctccacaggaggctctcagaaacattttcttgcttctaactggtaaatatggggagagatgctccccttttccctctctgatattgtagtagctgcacatgatggccagaatcactggaggcctcttgctgtccctgaggttgaagcacacacaggaaagaaggaagagctcggaggattggaggagcagaaccaaagctcgctcatctcccttttgaagctgctccacctctggacttgtcatgtgagctgctcattttcctttctgtttaagctggagtaaatgttaagtttcttgaaattttgagagcatcttctctgataaaaacagactcaggatgttggatttgatccttaattagtggaaggtaatcctcagttaccatcacctggaagtaacgaagagagatgcaaagagataagaaagccatgcagatgtatactagatgacctaaggtgcagtgtgtggcacatcccttttgtgtaggcaaggagtatgcataaacagcctcctttccttttctctccactccagaggttcttatgtgtgttctccacaccttggcagtctgatgatacccaaagatcactttttagataaataattttaaattagtaaaagaaaacgtatatataattgcaaaaattatattgtaatagctatcaaaatgtttaaaaaactaaatttgtggtatatattaaatgtgttctttctctgttttacataaaagtctattctatgtctaaagaccactattattttaaagtagtaaatgaaattattttgagatattcacaaatataaaatgatgtaaaataatctgcagtttctattgaccatagtcaaagatcttgttaatacttcgtggattattgtcctgaattcataattgaagaaaatagttaatttcagttataattggtgaactaataatgtaatggcttttttatccaatctcataggccctccgaaccctatctaaagatcacttgcttaggaagcccagttcttacctttttaaaaagtaatattctaatccaccttgaaggcaaccttttgtgttttactgattgggcttgcacatagagcattagagccacaaatgtgtattatagcaaatgtaaattaggactgctgccatctctaatcttgatcatttatgtttagaaatctcctcctagttactttgtcttaactaattgtaatgttggctggggattttctagacagctactagaaagaactttttgttgttattcagggagggtaattccaatatttcaaaattatttgctttttctctatcatctagcaattgaaaggttgcatgactcctgcttggaaataaactctttggctaggtggtattactaatcttagctaggacagcattaagaaggtgaaatttgttaactgctagaatgcctatcccaacaatctcaattcctattttcttggtccaaacctcaaatgtaattttctaaaaatcacttaaggctttactttacacttaataaacaatccagagaacaagaaaacattttattttatgacttagtagagctgtctcacaaaactctatattatgtttaagaagaagaaaacatgtttaagaagatagctgccgcttgccctcctctccaaattcctgtggccatagtgtttcatttaggacctttgttttgactcattccaatgaattttgcaaaatatttatatcttctcatttcaaataggatttgatatacaaaaaaatagtggcctctatttattgaatagcaccaggtaaatgaatagaattgtggaaaaggttatgagctacaagtgtatatagaaaatatatatatatatgttaatatatgtgtgtgtgtgtgtatgtgtatatatatatatatatatatatatatatatatagagagagagagagagagagagagagagagagagagatggattacccaattgaccttgggcaatcttgtcgatacagcaactttctcagcccccattctttacataagtggatatatttttagtaacagggtttatttaaaatgagctgtctgatggtttaatgatatccacaggtgtaacttttccagtaattgaattctcattgttagtggagactgttacaaactactggaagatagtctccttggggtttccatttgatcaggtttttatcatttcctgaaatggctaagcctcattaatggctactacttctactttctaaagaaactgccctgggtcttcacctggaccttatcaggcttcaataatgaaagatgtgaaagaaactgctaggcattagcattagagcagtcattagagacaggaattatatcattaaaagttactgcagctataatgaacatcaggataacagacaaaagaggtagcagggttgattagaaggaatcatacaaaattgggtaaaatggaaggcttcaagttttcaatttactttcttgagaatccgaattcaactgatttctttttgggggttcagggtggtatcagatctgctttgataataaagccatgaagtccaatttattcatcaaatatttattcatttgcatgcttattgtttaagtaattttgcttactaaaacaacatgtgctagaaatttctcaacgtaataaaggacatctattaaaaatccacagcagccaagatcacgcttaatggtaaaagatcgaatgctttcctcctaagaacaggaacaagacactcttgttgctgtttctattaaacattattctacaggttctagccaaaaaaaaaaaggcatgaaaatgctataaaaggcatccagataagaaatgaaaaggtaaacctaactctatttgtagataacatgatcttgtatatagataatcttaaataatccactaaagtactattagaacttataagcaaattcagcaagattttaggatacaaatattaaaaagtcatttatgtttgtatacactagaaataatctgaatgtcaaattaagaaaacaattccatttacaatcatatgaaaaagaataaaatacttagatatgaatttaacagaagacatataaaactggaattctgaaaactacaaaacatttttgaaacgagtgcaaacaattggaaagacaacccatgtttgtgaattagcagaaataatattaagataggaatactacccaatgtcatctgcaaattcaatgcaattcttttcaaaatttcagctgggcattttgtagaaattaacaagctgatctaaaattcatatggaaatgtaagggaccaagaaaagacaaacaattttgaaaaagaagaacaaagtaggaagacacacttctcaatttcaagacttactctaaagctaaagcaatcagctaagtgaagcagttcaaaacatttgccttggcagacttgtcattgtgatgccttaaaattacccatcagcactgaggcttgtgctctgttcagacaatatggggggaaatcatttcaagagtgtgggttctgtttcaaggtcactcatgatgtcgggccctgctgaggttatagaattttctatctaagaatgataggcttgaattttgcatggtgattaagcaactttatccaggaaaggtgctgcctgtaatatctgcttcatacgctttccattctcaggttgatgaggctcagtgcattgctttttaggaagcccagtggctttactatttaccttcatgttttgtctaggaataaaggaagttgtattttctttttttaatgctttaagaaaaactggaaaggtgtcatttatagatgatactcatatttttggatttgtctggagactagtactacttgcttgagaaaggcgtatgtgtgtgtgggtggggagggagtcataattggagatctaatactcttttttcttcctacctgagccccaaaataaaactgacaagttgaactaacagaaatacttttgcttttgatttattttctatagcatagagaagactattggtactcttttaaagcaaagtttcaggccaggcccagtggctcacacctgtaatctcagcactttgggaagctgaggcatgtggatcacttgaggtcaggagttcaagaccagcctggccaacatggtgaaaccctgtctctactaaacatataaaaattagccccgtgtggtgacaggtacctgtagtccaagctactcaggaggcagaggcaggagaatcgcttgaacctgggaggcggagtttccagtgagccgagattgcaccactgcactccagcccgggtgacagagtgagactccatataaataaataaataggtagatagataaataaataaagtttcaggctggattctgtagtgtagtaatcacattctcctcacaaagtttcattaaagctattttccttatcctatccttattacatctaaagttttatattgtttggtgcatgccattgtatttattcctgttaagaagactgttgaccagagtcttcttaataggatgcagggtccatgaaaaatcatatctgtgcccatttcactttctagacacacttttatacaagggaaacatggctgggaagaacttccaaaacaaccttgctcatggtaccaaaaggatgaatattcggaaaattagtagatggaactccacagtaaaggaaaagatacattcatagtaagagatttctgggggaatgcatattaatgggtgagggcgttctttggtgctggatggttgtgaagcatggtgactatgaatgtgggctctggagccatattgtgtaaaccatgtctcagcttatcacctgtgttacgatacctgtgctattgtaagcaggtgacttgacctttccgtgctccagtttcctcctgcaaaggagaattaaaaatcatatctgccacagagagtcatgattaaatgtcttaaaatgtgtaaagagctcagaatagtacctggcatgtagtaaacactcaataaatgttagctcttgtggttgttaaaaaaaaaaaaaaaaagacgttatggcaccagaatgaggtgccacaatggaacaaacttgagagtccagatataacactatttgtggtaaattgatttcaacaaggctgccaacgttattccatgaagaaaaaagatagtcttttcaacaaatggctttaggacaactgatatctacatataaaataataatgttggaccacaccatacacaaaaattaacttaaaatggattataaatataaatgtaagagctaaaactataaaagtcttagaagacaacataagagtaaattatgatgaacctgggctaggcatagtctttttagacacaacaccaaaagcacaaaagaaaaaatagaaaaaaaagataaattggagttttttaaaattaaaatatttgtgattcaaatgataccatcaagaaagcaaaaaacccacaacatgagagaaaatatttacaaatcatgtatctgctaagggacttatatccatcatatataaagaactcttgaaactcaacaataaaaagacaaccaatttgaaaagtagtcaaaggatctgaatagacatttttccaaagaagatatacaaatggtcaacaagcccataaatagatgctcattgttagtcattactgaaatgcagatcaaaactacagtgagataccaattcatatccactagaatagctatagtaaaaaaaaattggaaacaacaaatggcaagaatgtagaaaaagtagaatcttcaaatgatgctggtgggaatggaagttggtgctgctgctttggaaaatagtctggcagctactcaaaagttgaaacatagggtggggtgtgatggctcatacatgtagtcccagcactttaggaggccaaggtgggaggattgcttaacaccaggagcttgtgaaaagtttaaatgtagagttaccatatgacctagcaattctactcttgggaatgaaaatttagattaaaacatacacgtgaatattcataacagcattgtttacaacagccaagaagtagaaaaaactcaaacaccaataattgataataactaaataaaatgtggcacattcattcaatagaatattattgggtaaatgaataagttactgatacattctacaacatgtgaactttgaaaacattatgcttattcttttttaaggataaatagtattccattgtgtatgcacaccacgttttctttattctttcatctgtcaataaacacgtaggttgtttccatatcttgactagtaaaaataatgctgcaaaaaatgtgggagtgcagatatctcttcaatatactgatttcattttctctagatatgtacccagtagtggaattactggatcatatggtagttctatttataattttctgaggaacctccatactggttttgatcatgttcatgctaatttatattcccaccaacggcttacaagggtttctttttcttcaaatcctcactaagacttgttatctcttgtgtttttgataatagcaattctaacagatctgacataatgtctctttctggtattaatttgctctcatctggtgattagtgatgttgagtgtattttcatagaactcttggccatttttgtgtcttcatttgaggaatgtccactcaggtcatctgctccttttttaattgggttgttttcttgctattgagttgagttccttatatattttaaatattaaccccttattggatgtatggcttgcaaatattttcttccattccatgacttgtctctttactctgttgattgtttgctttgctctgtagaagctttttagtttgatgtaatcccacttgtctatttttgcttttgtcgcctgtgctttggggaccatactttttaaaaattatttcccagaccaatgtcatggagcatttttactttgttttcttctactacttatacagtttcacatcttatgcttaagtatttactccattttgagttgatttttgcatatggtgtgaggtaagggtctcatttcgtccttgtgcatgtaaacatacagtttttccaccttttattgaagaaactgtcctttttccaacgtgtgttctcgacatccttgtcaaaaatcagttgactgtaaatgtgcgaatttatttctgggctctccattctgtaccattggtctatgtgtttttatgccagtgttgtgctgttttaattattatagctttgtagtagacttgaagtcacataatgtggtgcctcaggctttgctctttttgctcaagattgctttggccatttggggccctttatagtttcacacaaataagattttagaggttagagaaagacattgttgctcccattttcaaatggaaaagctgaggtttaaatggtcaaatgcccaagatttcttagtgaataattaaattcagaaacttgtctttatcttattctagatagtttttaagcagaaatttctattaatctccctgaaaaatatcaagacacattaaacaaggtccttatgttaattctcatctccatcccagcctatattgctgctaggtgactcttcccaaaataagtgctaattacatcacttctttgtatccaaggtttttttttttttaatgattcttttttgtctccttagttcttaatctgctgttcaaattccccagcaacctgcctgtaatttactttctcaaaagcttaatctaagcttatatacttctagacacattttctaaggccaaaatcaaaaacaaaacaaaggaactactactatttactattctttacacattttcctcactttcttcattttatgcctttgaccatgttctgttagcttgaagtgcctttcccacctttgactctatatagctaaaacttggctacacctcaggttcgtcttaaattctacttctgtcaggaaacattcacagagagtggggtttggggttggcggttgaggggtgatctttctcatctttgaacttccccatactttattgcaataaagtatttgccactttgtattatagttctttgtagtctgttttatcccatttatgactcctcatttccaaaaattgaaatattagctaagggactttattttggccaaaattagcctgttgcttctaatgttcttttattgacagttcatttatgtttagtctgtgaagggctatcttgtgtgatttcatgtatttattcatattttctgtcagttgttctgctataccttttattaattattcagtagtatgtaaattagtctcatgttttaacctataaaaagcaacagtgggtgagccagttaaattttctttgcgaagctgctatttttgtcttgaggaatcctgttgaggttttcttgaggtgaatgatggaatatcaaagagggacgtaggactaggagggaaaaacagttccccttgaagactagaatgaggaatcacaagcgtggttttcatttgctgccttctgaactgaggaatgagtttaaagtatttgcatatattagatagaagcaggagaattccagcttctaacaacgcttcttcccaactaaaatgaatttatagaaaatcaggctgtctagtggtgacatttgcatttccgattaaccatcaggcctacagaaactccttcagctggtcattattactgacagcttagtatatcaatacattgtcaaagaggactttttgtaattaaactcccaccccattgcacctagattcgtggtcatgttctggatttataagtgcagcttttgaataacatggcttcaaataaaatgtctaggtaactttagaaaaatttttatttctgtccattttacagtaatataaacttttcatccagccccttaaaactaaatccttatactgttttgccaatccatagttcagaaaactttagttttaaggattggaaatgtattgagtaagtttccctgacactgcaattggctgtttacatgctcattaggtttacttctcaaatgtgctgtgagttcaaaattacttgtaccttataaatataatcagcaaatgctactgggggatgaaagagtttaggacaacaaaaactagcatgctgtaggctaaagaattctgtcttgcatttgtctttcctcccagtggagaataaactcccagttaaaaaagactagcatgagagttttgtcttatttcctcataggattcttaaatccattagatgtatttaatcatggcaattgttcctggaacatctctgagtataatcaaatgaaccagtgttccagcttctaaagttattctgaaaaaaaggcaaacgttcacaagatagatataatcaaagatttcactttttcttcatgaatctaactaacctagggattctttgtagcactgaattcaaggtttagtatgtggccatggggaaagaaatggaagttccacatcaacaatgttcaacctccaagccaaagcaacccatttggccactttattcaaatactttgttagcctagtaaaaacatataggatgtccaagttacttgctcagtggtttccaggtgaggctgaccatcagaatgccctggcaaagtttctttaaaacactgagattcctaaggtccatcccagccttagagaatcagaatctccagggatggggccagtgaatttcatcctcaaaagattctgatttgcagctaggtctaaagaccagtggagtaaaccaccattccccagctactggtccaaggacactgaggagttacttcaatgtctttttttgtatttccttaaattttgattacttaattccttttatgagcctgcacaagaaatagagtatggcaagtaataaattgcctacctcaataaattaactcctgttccctactccttaataatcaacaatatcaccattattttctgatatctcaaacctacacatttcatctgctaatagtgacatatttgaacataattaaaatattgaaacccttctcttccctgttggtgagttgctcaagattggattattttatgctcctggagcatattttatagttgaagaatatacattctattgaaaaaaaagtttttaaaaagtgatgcaattttatgtaataataagttcaataataacaataagtttttaaaaacaagataagggaaaaaaagtaagaaagataaatgatgacaagtttcaggaaaggcctttctgaggaggagacattttatatgacaattccagtgctgaagatactgtctgctatattttttgaacctgagtaaatattagttgaatgaatgaatgaatgacaagagtaaggcctcataagaatctatgggctgagcctatacaataatacaatcttgggatgttctaggaatagcactgtctaggaacagcatcgactaggagagatgggcgggggcccaacaaagtggggcctggaggtcttgataaagagttgagactttattctatgtacagatggggatttagagagtttcagtcagataagtgatatgtttatgatatgtttatgttctatgatatgatatgtttatgttctatatgtttatgttcatatgatatgatatgtttatgttctataatgattactcaggttgctgcgaggaaaatggaaagcagagagatgagacaagaggacattgccaggctttagaacagggtggaggttgtagacttggagaaaatggctcagattctggaaatagtcaaaggtgaaacaatgagtcttgctaatggagtggctctaggaagtaagagaaagagaagagtcaatgattaacacatacatttggttggagaccctgggttgatggtacaacctacctaacgaggtcaggaagactaaggagaagcagggtgggggagggtagaaaatcaagagttctgtcctggaatggaaagcctatcagacttcaagtacagatgctgactgaggagttggatttacaagtctgaagctcagggctctggctggacaaagggatgtgggagtgatcagcataacatacacttggactggccttgcggctccagcttgccttttccgcttcctttcctctcctcttcataactactcccaccttccctcttctacttcctcccaactctcttcctttgccccctcctctgctatattagatgctcttttagaatccattgccctcttttttttatcctatattttttcaccacgggatgtgttatttctggcttagaaatatacagtcacaagagaagatttgaattctactgtataactcattaagtcacttgctgctctctgggcctcaattttctcatgtgtgaaacatgcagtcaggttatatcagtggatgagatgacagcaggatgcccagacactaatcctgcttcaagccttgtagatccgattttgttgataccatcgttgttgttgttaacaatgatgtttagataaaatcctactgaacaaaagtgtccgtgagcagaaatggaagtttggaaaccactggcttaaaatgataaatgatctttaagttactctctgtcactgaattcaattttccatgtgactaatgtgggctgagaaaatgtaagcagaagtgattggggtttagggtctaaaattaagactcagtattatgcactgtcctgacatctggtaaaatcagtagggcttcaaaaggcttaatccccagctcctctcccctctctgctcccacagataaggtgctcaaaccaaacaacacttcttatcaaagggaacacagacagacctgtgtttccctgaataacaggtttcattgcttgctaccctgtgaaattattcaaacaagtcaatcacttcctcctgtgtgaatgaaggggcacctcatcctctggacactacactatctgcctctccctgcctttgcttatccactccattcccaagtacaacccccaggtggccctccatcatgtgcagtgtcctctactccaggctgtgagtataaccaacaaactgctgtcaatctcatctgtccagtgtcaggtgttgtgtatcctgccatctccatgaccctagggagggaagatgaaaatgaggtgggctgggcatggtggctcacacctgtaatcccagcactttgggaggcccaggtaagtggatcacctgagatcgagaatttgagaccagcctggccaacatggtgaaaccccatctcaactaaaaatataaaaattagccggttgtggtggtgggggcctgtaatcccagctatttgggaggcttatttggaggcttaggcaggataaaaccttgaacccgggaggaggaggttgcagtgagccgaaatcacccattgcactccagcctgggtgacaagggcaaaactgcaagcaagcaagaaagaaagaagagagagagagagagagagagaaagggaggaggggaggaaaggaaaggagaaagaaaaaaagagaaaaagaaagaaggaaagaaagaagaaaagaaaaaaggaaggaaggaaggagagagaaagagagagaaagaaagagaaagaaagaaaaaatgaggtgaataggaagccatgaaaacagtaatgcaggacacttttttttttgagatggaatcttgcactgtcacccaggctggagtacagtggtgccaactccactcaatgcaagctctgcctcccgggttcacgccattctcctgtctcagcctcccgagtagctgggactacaggcacccgccaccacacccggctaatttttttgtatgtttttagtagagacggggtttcaccatgttagccaggatggtctcgatctcctgatctcatgatccacccacctcggcctcccaaagtgctgggattacaggcatgaaccaccgagcctggcctttttttttttttttttttttttttttttgagacagagtctcactctgttgcccagactggagtgcagttgtgtgatcttggctcactgcaacctctgcctcccagtccaagcgattctcctgcctcagcctcctgagaagctggaattacaggcatgcactgccacgcccagctaatttttgtgtttttttttttttttttggtagagacagggtttcaccatgttggccaggctggtctcgaactctggacctcaagtgatccacccacctcagcctcccacagtgctgggattacaggtgtgagacaccacaggacacatttgtgtaaaagttttaaaaaccggcatgtagttttgcccctctcttttttcatctgacatcacaatgtcccagacaaagggtactgttttagcctgagcctgattgaagagctggagccaaccctgagaggcagtcacagaagtgagaaaccaacattggttggtacaagcccctgagatttggggttttgttttttgttaccttggaataatttagaataacttaacataacttagcctaaactgagttgaaaacagatttgtactggggagcagagggcaagtgcaagtagagagcatgtagacactaggataccaggagaagaggaagggggaaggggacaggaattatcttagtactgtacctagtacagatattttgtactcatttctttttactttatctttatgacaatcctataactaggatcaatacttagctcttctcttagaagagacaaagaaactagtatcaaccagcaagatgggatttcccaacttcagcagtcctgaccttctgagacagataattctttgttgcaaggggagaagggctgtcctgtgcattgcaggaggtttaatgctctttggcctcctcccagtagcacctcccagatcataacaatcacacatgtctctagacaatgccaaatgtttcctgggggaccaaaagaccctagtcgggaaccactgcagtagagtcctgaaatcagacagaagtccaccttgcttaaatgtctatgccatttccatgaggccctccagacagcactgaaggtatgcaaagaaggaggacttggccccctcttgacctagcctgggccctacctggcctgtttagtggatcaggatggaagacagattctcacttgcctcactgacttacctgagctgtcatctggccctaaacagcacagcgcacactgtgcatatgctccatatcctgttaccaaatagctgagctgttcttccccacagaggatgttcctaataaattataggtctgagcgagtgatgagcctgaggaagggtcatgatgagtctctctttactgctattaagaaaaaataaaaccgtggttaaccacatggaccatatggggaataaatcaaggaaacttaaatatgtactaggaggaatttctgaggccaggaaatgcagctctagcttgctctcctgccaacctgtgaaaagactcatgcttgatgcatggtgaactgtgtcctgtggctgtcagccaggagacttctggtgaggccacgggcatgaacaaaacatatgtccatggggcctcctcctgcctcccaattaaggggcagaaataacactccacctcattgggccttgggaaggcaggctaagactccaaacattaattaccacaatgtcaaatggttacatctttctcactctctgagaaggaaaagcaataggaagccaccagtccttggagccccaaagtggtgtcctgttctgttctatacttaaaaggacagactcggccaggcacagtggctcacacctgtaatcccagcactttgggaggccaaggcgggaggatcacgaggtcaggagatcaacagcatcctggctaacatggtgaaactctgtctctactaaaaatacaaaaaattagccaggcgtagtggcacacacctgtagtcccagctacttgggaggctgaggcaggagaatcgcttgaacccgggaggcagaggttgcagtgagccaaaatcacgacactgtactccagcctgggtgacaggctcaaaaaaaaaaaaaaaaaaggacagattcccctccctttttctgtagctatttggtgccagtttgcccttctctttcttgaaaatgatgtcagagctaaagcgcatgctcccatcagggcaaatgcttacaagaaatgaaaactccacagtccatgaggcctgagagaaaagatgctgctttgtcccataccaagtccctgcttctatctagcccctccaaatgtcctagctcccattccatcttcctccttcagcaaaccaagggtcctcaagcaaaacaccacgggcacatagactacaatggccacccgtgctcaacacctcaacgatgcagtcatttaaacttagacctttttaagattagctagaattaccctagctatgatgattaacccacagattaagaaaatgggttagaacccagtacccttccccacctactgttactcatttcattgtaattcatatagttgtaaagttggtgatacaaaccttgcatacagagggacttgtttgattatatattttgaagaataattcaaactcattatgatatatatgtggggaggggcatctcaagaatgtaagtctaacctataatcatgcatcattattgtgtatttccaaaagaaaacagctagcactctcctggggaattgctactgcctggtgaaggacttaggagaagcagagtcaagacagggtggcatgtaatataaggttcccactgcagcattgtagctgacagtgaaatccctaggttgctcagtgatgtgtttctgatagtttgcattttggttaactgtcattgcttaaatgtgtgcatgcaaatgtacagaatttcagctgtcttaagttttctagtttgaggatatgtttaatcctctttaaggataagtaatttttattattttagagtcagtcttctacagtgtaacagcttccattcatttacgacgcatttgctatgggtgggcagcatgagctccaggccattcttggttagaagggggtttttgaagagggtcttattgcttaagcaggttacttccttaaataaaataagtgaaacattctcaggccttggaaatttatctatgtttgatgcaattgcaccaaacatatgggtctttaaaggatgcctaaggatctaatgtgtttatcggaatgttgaatatggatgtggtatgtttctgtgagccctagattttagaaggttcatagtgtatctttttccaatagctatgaaacttgattcttttactttcgtttgtttgttttttgttctttgcttttgtgtgactttctctcctacccttaaatgaatgtcatttctttgaatttcctgctgcaataactgctttgataacaaatgaaaaagcaaagaggaccttgggtttactctcccgggttggactcagttccagtaaattgcagcacttaaatctactgatttattgtacacttttccatgtctacatggcaaaagtcccttataaagagaagctaatccactgtttattgttctggttttttgttcatattttagcaatcttaatgttaatctcagattgtctatgtcaataacaaatcaatcacctgaaaatcaatcattaaaataacttgtaaaaaagttttgcatataaaatgacctgattcttcaataaatccccatttattttattcaagataattgttattatattaaatggttgaaatatatatatatatatatttatccaaataagataaattattcttttttgcttctaattttgttgagtcttttcatcagacaaatcttccttccagacagttctgaatgacatgtgatggctctctactgaaatgcatgcaatagcattcaaatccagagcttagaaaagcatccggcttttctaagtaggtgctcaataaatatttgttgaattaatgagatgtagttaacaaaattataaagcttctccaaccacaagaacaaaactgaatttttgaaacacccttagatgcacttcaaagtatagaaatgaaggggtttgaggaaggatgaacagctcagaagccaatcttttaataatcaccttttaacatcaccacctttcctctactcctttcatcattcctcatttcaattttaacatcaaaatcatctcagaaagccatcttaggatcaaggacaggtagaaattcatagtacattagccattaattttcatttaaattatatgaaatgtcaccactatcttctcaatttaacatattcactattcactttagttgcatatgctagtatgtacaggggggaaaatcctataaattgctttcagaggcttactatgactacatcccccttaccttattttccctttaagatcttaaattgtaccatgctaaatctttatatcacaagcaggttacagaagcaaacactaatgatattggcatatgatttggtgtagaattgtagatttagtgatttgccagttgtcaaaatgcaaatgaaaaatcctcaccaaaaatattccaagattatgatttccgctacctgaaaaatgtcacaaaatcaccaccaaactgagcagttgttctagtgcacaaaaacagactaaattaccaagtagaattctttttttcctaattctaagttcaggcaaccacaataggcagcctgtgacatagtacgcccttgaatgattctttgagctaatattgattgcaataatgattttcctaacgagtcaaaattgacttcacaatacaagtatagttatgcatgtttttccggagtaggacttggaacaaaggttcacaatgtcatgctatgtattgaacactattagtatgagttaactaacaggtaattgtatccattggaaccgattagaagggtctatttttttaagagtcagagaatacttttttaaataacatagcctctgactagtaggtgcagaaatttattcaacaaatattgagtgtctactttgtgctgctgactttcctatgcactgcagatatagcaggtaacataacagcaaagtgcctattgtcatggttgtgcagggttttgtaagtcaccatagggacttttaccagggaggaggtagacagccattggagagtttgagagaggagtaacataatttgatttatgttttcaaaagaatactctgctgtgtcagaaataaatataatgaggtgaagaagcaaaaagggagaccagttaggaggccattgcactaatccagccaaacaggatagtgaattagactagaaggtgtacagtggacatggggcaatgtggttgaattctgcataaacagaattttgaagatagagccaagtggctttactgatgaaatgaagttgtagtgtgagaaaaagagcgaggagtcaaagatcacgcaaagaatttggggctaagaagcaggaaaactaagttttcctccatttatcagaatggagaagactacaggacaaaagagtttggaaggactgagacctcagttttggatttgttatgcttaggatgcttgttagtcagcaaatgttatgcgcagcaagacttttctagtttattcatttattaaatattggttgagcacatactatgggctagacatggagcatacagtggaaagcaaaaatagacatgcactctaccacactttgagctaagggctagtcagaagtctacaattaaatgaagtcaaacaaataaaaggaaagttacaactgtgaaaggtgatataaaagaaagatacattatacagataatggggctttgacctaaatcaggaagttagtaagggcttatctgaaaatgtgagggctgagatgagacattaagaacaacagtcaatacataccatgatctaaaccagggtgtccaatcttttagctttcctgggccacattggaagaattgtcttgggccacacataaaatatactaacactaacaatagctgatgagcttaaaaaaaaagaaattacgcacaaaattctcataatgttttaagaaagcttataaacatatgttgggccacattcaaagctgtcctgggctacatgaggtccttgggccataggttggacaagcttgttctaatcaaaaacatatttgtgtgatgaacgaccaacacttaattaaagccagcgtccaagatgtggtgaaaattcaggaatttaaacgttaggacaataaaagttcctagcaaagaaaatgaaaacaaatggggaaaggaatggtatgaaagaagaacccatagaatgagaaatctgagaaagagatactgcaaagtgaaatttcagtcttttcttcatttccattttgctgaagagaaatggttgcccttaatatagtacaacagaaagaactaattagaccatccaccaacaactgaacacagagtgttgatgtgagcggaactgtaacatcactaagttgtaaattttcctcaccatatttatgacaatttgtcttaaatttcttcccctgtcaccttttattatacaagatcacattaacattttatttgagccccacaaatgtgaacctcttcacaggaatttgttatttttatgccaaaatcagcttgttttgtgattattattttattgcaaccacattttgctgtcatttattgtctttgcaaaatcaaattctgataaaaactgagaaggggagacttggagggggaatacctttcctatctgtaaatgtaagtatcttgtaatgaggacagtaattgatcttgaagaactacaggctgagtcagaaattctttcagcctctctatcctttttggatttcaataaaacatttaaaaaagattaacacagtattggattgagtgaaggcatttacagtgttctcattatttcttatcaactaccaacactaatttcagataactctagtgtgtaaggaagatataagtgattctgcagtcactgattatcactgtgaattttgaacattaagatgctattgatatcctgaagccttcccttgtatacttaagcagtggtttggatgttggctgaaggagaaatgaaccccatgctgacaattagaatcttctgctgtcctagaactgtttaccacaattctgtttcttgcccttcacctattaaaataattgaaagtaatggcaaaaaccgcaattacttttgcaccaacctaatcctttactttgtaccactgagagattgactactgcctgtcacaggggagagggatctcaaggcttcccaggcctgcaactttttataggatatgatcactctacaggtacctctgcctccctccttcctccaaactcttaaatcaaatttaaataataagatatactaaaatgtgtacaagcaacatcaaatgcaagctaggcttaggcaattgttctgcactttttctgctttattttgttggtacagaaaacttttaaataagtcacgggccatctgttggccttaacctcaaggcaccagggataaaagggacaccaagtttacatatctgagtaccaggaaaaactcacagtgtgctgatttactaaggctcttgaaaggaataccctgggaattaatttagctcaagatgaaattcaatttgaagtttttcttctttggctttgaaaatatgcaaagaaaaaaatagtactgtcatgaccattcaattatttgccatcattccttaatttgctattttcaaagtacaaatccataatatttacagagttgaaagtgccttcatacatcgccaaccattcctgaaatcaaagctctgatacaactacaaaatatcttcagttatttttctaaccaactgaggactttgttatgttttctttaaaaaatacatacaacttagagaaatttagaaggtttccatggtagcatttttgtaagctgtgtagccatggctaaagacaattttgcactggcaagctttttctttcaaattttttcattcccttatctactccattggtactgttggtgaagtcttatccttaaagtcttatgtatgttgagcactttggcttcagaattgcagataagtggcttcagaacagaagacaacacggtggaggggatctttgttgaacaatagacatagaagacattcagaaagccacatttcaaggagcaatacttctagaagtgagttggtgttttctcaaagggttggatacttgtgatagatttgagttcagacagccacaaaaattcttttcttcaatatcacaaggacctttcgggatagttttatcaaattttcctacgctaagagactcatacctgctggttgttcgattatcagtggacagcttaaataatcggtttgatactaaattttatacagataatttcaatgataaaacaaaaaatccaggagttgataccagaataaaaagatcatgtgtgggttggttccacagaagagagtttcataccttcagtgatgaattctaagcccgaaattagtagaagtgaaaaacatcctctgaaaggctcctttaatgtatcaagtggttggtttctacaaatagaaatacccatcataataagtgacaagcatgaagaaggtcattccagttcaaaagagaaaagattctaaaagttaggttctgaatttctatgtttctatccgatgtgtttcctggctatttttgtttcccctgtaagttactaaactatcatgacttttctcaattctccctcatggcagtcactgggaaaaaaaatatgaatttaattaccctaagagttaaggtttatctgaggtcacagtatttattgctgatacctgaactggaaagttgagctgatctccttattctgccgttgggtgtagaccatgcgtaagatcttatgatgtcacctagaggctaatagaatatcaaaacccaacatgtcagcactgaaagatatcaaaaacattaatttacctccaccttgaaaagaaacaaataaatagtctggactactccaataaatgatggactttgcttcctctcccctgcattgtacttttcttgtgtgcctctcatttagtgcctccaacaacttaccggatattctttatctgcattcctcatttttccagcaacaaaataagttctcccaaggccagagttgtatgttgcccagcttcccaatgttgggtttttaataggctcaactctcgttttcaaagcttatacattttacctagggcaagttacacatgttacatctctgagtttgatttctgcgcaggtaaaaaggagatgataataataatagctagctcactgagtggctgcagagattaaataagataacataaaaggaaaagcactttacaaaaaatgtacagatgacagttgttattactaatgaatgttaatgaatagttcattagtcaaaaggctagaacaggataaacaatctcaaaggaggtgtttgtgacaccagaagcaaagctttgggcatgagattggcaatttggcatgtagcatctgtgctgaatgctacccctgcccttcaatttgaccagtatttcaactgtaaaccatgatggagttttctgttggcagcaatactactcctgctgctgcagctggaatggaaagaagtcaatttccgttacgttcattattggcatgaagagctcaccctgtgattccttcttattcattttgccaaaatgacaccagaactcagtgtgggccaccaaaccattaaaggcatttcataatttccagagaatctttgggcctgcttggtgctagagtggtaaatttattctatttcttaagtattaaatcatatgattggccaaagtagcttgagagattcccagtcatactgcttttccatgagtctcctgtggctagtccagtctccccacagagcttctcagagcttgagagaggctgggctatttctacttttttagtatacggtgacataatgttaatgtatgaacaataaaacaaatgaaaaaatgtaaaacagaactacacaaagttggagtgtatttttaaagttcacatttaataaattaatctttttaccacaagataatatggtgctatacaattgctattcattggataattctgggactcatttttaacccttcccagtaattggttttagaaaatttatataacgttttcaagacaatgacatgggagaggaagtcagctgagagtttatcagactttttaaaagaaacataagaaagggacatttctctcttctgcctttgaatggtgtcttcaacatttagccactatgaagtgtttaaggaatccaacctaaggaaaaaaaaaaaggcatacatcccggaggatggcagagaggaaagactaaaggacatttgtccttgatgatgttactgaattgctgaattatgcaacttagacactttctgctgaactcagccccattccagtctctctctgctcttcccattattggggtaggctggggtgcagtctccactattacactgtaatcttcttgaggacttagactctgtatttattcatatttattattcaccattccttgcacagtgacctgcccagagcaggggcaatttattcatggatattttgaaaccaaaccagaggcatgatgcacactttcctttctccactatttggaaggacttgaggtttcctttcacattttcagattcaccagtagtgaaaacaaattagcaactccaatcctgcctaagcccatgtaaagtagatgtcagtgaagtcttttatctgtacgttgttgtgctttttttttttttttttttttggacgtaagcaatggcgatggcgatttttgaggcaaaactgaaaatctatgtataaaattctgaattgctgaaccaggcttaacacaattgatggctctttaaacaatccagctttccctttaatgggtcttcatcaagcactctccatgctttccaagtgttccaaatgaatgcagtaaaaccaaactagcgtagtggccaatttctttttggacagtttctccatctccactctccccacactcgccaaatcccaccatgcagcctgctgtggtagaaacctgcttaccagggaggtgtgggtgatgggttttaaacagttctaagtcagcagaggggaagtgttaatgcttcagaaaatcagccatctggccttggaatgagaatgccaggaagattcggaagggaaatcaagaaagaagagaagaaaggccctgctggggctctggggagaagggcacaggctgagggagaagggattctaatgtaattccagatctgagatgaaggggaggcaggcactgctgagtagaaaggctaggggtgggaggaacactctcagagccggctttatgctaagctgcttaaggaggatgttagtgaggatttggactctgggaaggaacctctgcagggcagcttgagctttacaagtgccttccgttgctacctgagaactggagggattcaaataaaagtctaaatgaaatgtttgtatttttcaacttaattgtgaaatgaatgcttgttagaggaaatgcgagaaatgcagaaaattagaaagatgcgaacactagtctcaccatgtaaccctccttcatcctacctcctaaacatggccactaccaacgataaggtgcatgtcttctattgcttttctatgccagggtttgcattacaaaatggtgatgatgctatttgtatattgcaattttgtggctttaacctaatgctattttgtaagcatttcctccattatttctgtgatttgtattactaaaattatgaataatacatcaaatatatacaattcctaacacatctatttacctatagttttgctgtttccaatgtttcactattataaataatggtactatgaacatctaaatgtaaagctttttgggtgtttcagattaggacagattcatactagtagactgatggagtaaatacacatgcatactttagtctattgacacattaaatagatatttaatcctgaaaaacttctacatgccattagaaataaaatactttgttcattttcattcaagaatacatcacccctcttccatccttttcttcctggcatagtgtagaataacatcacttaggtttacaaagttctaggtatctttgcccctgaaaagcgaaatagggatatagcttgtagtctgtatcacttgagtatatgcctaaaaccactaggtttgtatagtgaaaaatgacatttctgcccccagcagcaacaaattattcaatagaaatgcagttcattgttgggggactgaagggttgatgtcaaatgcacaacaggaaagcatgtaataggtcaacaataacaccagtgccacacctgcagttagcagccactaggtgaacagaatgctttgcaggtacctgtaaataagcattatatagataacagagaagcagaataaatagatcatatcaatgcattataactttcaaaagtttcttaaccacctaaagatttctttttgcttctaagtataacagtaatttcacaagtcaaaccacaataagcaacattttttaaaacaaatgtaaacagatttctaccttttactaaatctcaattccttcacatcacttcccactagtaagtagtttaatcatatccttcaacatcaatagcctgtaatgatttggcttatatgttattaaaaaacatgaaaatttccttttttctctcttccatttttgtaacttttaaattctgaggttctagctcctttgtagtgtgttatagagctgctgagttttcatatcaacaaggcttaatctctccttttacatacagggggatatggcctagctaagggaaggaacttaatgaatccaggattagaaattaaaaatttacctttgatttcccaacccactctcttctgcttccctatccataaagaaacatgttactgatatcaactacgtttctttctccttacaccattttttgcctgttgaatgctgttatggtttggctgtgtcctcacccaaatctcatctcaaattgtagctcccataattcccatgtgttgtggaagggacctggtggaagataattgaatcacgagggtggcttcccccatactattcttgtgacagtaaataagtttcacaagatctgatggttttataaggaaagacccctttcacttggctctcattctctctcgtgcctgctgccatgtcagatgtgtctttcgccctccgccatgttcgtgaggcctccccagccacgtggaactgtgagtccattaaacctcttcttctttgtaatttacccagtctcaggtatgattttatcagcagtgtgaaaatggactaatataaacacttatgaaaaaaatcatcatatttttcattttatttttcataaatcatcatatttttttcataaggaaattactaatcccagaaagactaccccaaataactcatgttcctgacatttgtaatgaaatagttctaatttattaccactgataaaatatataggcagaaaaggatcactgtgagtctattaatcttaaattgaatgtagctctaaatcgttggtcgcaagtcttacggagaccagcattatacgtatgtaagaaaccaaaatttgcttgatataaaacaatcattttaatcaataaatacattaatgatgagatattttcaaccactacaaaaattgtagaataggccaattctttctttaacaataaaataattttagtttctgcattgcatttctctgaacaatttcatgtgaagaggagaatatctttgcaaagtctcttattaacccagttttaacaagaagtacaaaatagaaggcaatcagcctttgtacatagcattatgatgatggtaatcgaaaccatgcaatcacatggatattttgctctctataactagctctgaataatcagtgattttcaatgcaagaaaaggggctattccaaattgcaacactagcaaagcattgtgatgtttacatttaacccagatgtattttctcttgatggtatttataaagaacaaaattcaatgggagagaagagaactaacagttgtttttaatatttcagattagtcgagtacatgattcagaattgtaaaaacacagcaatacttgcatggttttaccaaattactttttaaagtgctaccttaagaataagataaccctcagacattgacttaattctttcatgttctccaatatggctggaaatgttgattccacacacagaatggaagtagcacaagattttcaatccttttcaatgtaaggtgatatagtctggcctcagtgcagcatttcaggagtacaacatactgatggtattcacatttctttataacacaatttacatgataattccctcccttattaagcattgttcacttaagggaccagagaacaaaccttgggggtctaagagaacgaacatttgacatggatggagagaacagtagttttatgaagaaaggtttgataatattcaccaaattctcaaagtcatataaaaatttgaactgtccaactttgctagactttgctaaggtttttcttcaggcaaatttcttctagctctctgagttccacatccaagactttggaagttgtgtctcctacctgggctatttcaaagtcccgtgatatatcaaaacaggtaataatgttattcctaaagactatcaactttctaaagattaaagaaatctttagtcttttttactagaaaattactgaatgatcccagattacataaagtccatttctaaaattcccactaccaccatcaaattttttgaacgccgttagcttttgaaaagagggaaaacatagtccattaatatgagaagacgtgctttagagggtttcaaatggaatatggagaagaaagtgatagaaacttggaaactctgagtgatctcaattaaataagccacaagaagaacagcaataagaaaagcttctgaaaatatataaagaaaaataattgaaaagaagatcaagaaatgttctccctttttgtgcattagatatctatctattcaccagcgtaataaaaaagggacctagaaattgtgaagcagaaaactgttctggagaattctcaacccaaacaggagatacagatatccaaggagccagcaaaacagaagatcatacagggacgttgaagttcaaatcaacaacagagggatggagaatattactacttgtagggccagaaagagggatgtagaggtggaacaagaaacctggggccagaaagatgacaatgagatcaagttcaagcagagattctaaaggatcaagcagatcctaaagacatctagaagttctgagatttttttttaaatctattttattttatttaacttggtgtttcataaacatatttaagaagaagatttaaatgcatttttaaagtaatgctagttaatattccataaaactagcattttgtagaatacacttggaggaattagcatctttgacttatgatctagctgaagcaatttaatgattaagaaagcaagctgtggaatcagaatgcctgaatacgagcctgttttcccactttattttgatatgatcttgatcttctatacttcagttttctcttttataaaacaaggcttatgacagcatttatctcataatgaccctttaagtattaaatgacataaaacctataaagcacatagcaggtaaatgtggtaaactcttgataaatgttattgttatcatcatcatcatcactattagtgaacccactcagcttaaagaactaggggaagagtagaatattggtcaggataggccacaattttcctatggtaacaacttcccaattttagtggtttaggcgtgcatgctgcagcagagaaagtcttctcatcttagttgctcaggggcccaggctgatggagccccattttttttcatgtgctcccataattgctgagccagaaaaagaggacacagagaattacacttgatacttaaagtttctaaccaaaagtgacataaattccttctgttcacatttcattggtcaaagcaagtcacatttttatatttaacttcaattatatccagacacattacccctctttgccttctttgtagttattaacaacttagtgccttaatggctcttcccttggctgctcaccatgtttatatcatatatcacttttgaccagcttttctgaaatggtaagctttgatgaatactgtccctctgactctaaaattaagaccatataatctttaaaggctttccagccctaaaatagtgcaattctaaatcttttccattgtgtgttttaggccattaggtagccgcttgtttatctacagaatgaccactggggtccactcttatttttgaatagtgatgagtaaggaagaaagaatattgaaaaaacaatcctggagtataaaggtaaagagttttaaaaatcaaaacataaaatgttttcttattggaacaaacaactaggccagaacgacatgaataatgcaaaaaataagtttcttgtcccccatcaaatagataaaatcatggatttagagtactttttatctttccacagtatatagcaatctttctagaagagtgatccacactgggatgcttgctgaaaatgccgatttctagtctgtacatcagatctgctgaactggtttctgtgcagagttagtaaagtgtctggagcatattaggtgctcaataaatagcagctatttctattattaacaggtagaatgatcaaactattttgtatttctttaataaaaaaaagaagaatgcaaaggaaacaaaggcaagatttcccttagttgccaaaggcaatatcaaggccactttagcagaaacccaggtgtaaaggctcagatgagaatgatgatgatagtaatgaagaacaaaagggctgggcatggtggctcacccctgtaatcccagcactttgggaggctgaggtgggtagatcacttgaggtcaggaattcaagaccagcctggccaacatgttgaaacctcgactctactaaaaaggcaaaaattagccagacctggtggtgggtgcctgtaatcccagctacttgggaggcctgaggtgggagaattgcttgaacttgggaggtggaggctccagtgagcagagactgtgccactgcattccagcctgggcaacagagtgagactctatctaaaaacaaaacagaaacagaaacaggtaggttgaggcaggagaatggcgtgaactcaggaggcggagcttgcagtgagctgagatcatgccacagcactccagcctgggcgacagagcaagactccgtctcccgtctccaaaaaaaaaaaaaaaaaaaaaaaaagaacaacaacaacaaaaagaagggctttggtaatttaagtcaaaagaaggaagagcaaaggagtaatccaaagacaaccccaagttcccagcctgtatcagcgataagcaggaggtaactaaattttcaaaagaatagtgaaggcaacaaatgtgaaaaaaaaaacttcaaagaattagcagagccacgtggctgacctagagcatttgggccagctttaggaaagggatatatgggacccgtgtttcatagaaaaaacggatggtaatttgtgacagacatgatatgggaaggggtgacagagagtgagggtaagctaaaggtaactttgagatttcaaggcagcgtgtgtgacaaagatggatggtgtttaatgtgcagccaaaaaaaaaaaaaaaaaaaaaaaagcaagagttggctaagctttgtttttctggtggtagaaatgtggcttcgaatccactgtaaactctggtatctctggtttattctgttctaaaggggcaacacagtttattagttaaagccaaaggtttggtattgcacagaagtctggacacaccgcctagctcaaagttccgtgacgcttctttttcatccttctctgcctctttgacttaatatgcacctccactccatgattcacttgggttttgcaacaaatccctcctgacaagcccacaaatcctcccagacttagtgcaaagtcatggagctgaactaacttccccagttcttgttttgacgtttgggttgttatttcaggtgtgcagaaagaaggcatcctaacaacaggattaaaaatcttagagaaagactcctggaagggtagttggccctgccacaggacccggagagctgttcacacccacgtgaatgacaactgcaagtttcggagagttcctggagggaaccgcacagcagaaagctcgcagcttgatcctgcagatgccaatttgagcttgcagcctgatatgtgttttgatttcaggactcagcaaattggatgagaaagccataaatgggtgatgaatatgaaacacaaatatcctgtttgtaataaactatcacctgtcttttgagagacacatgttttgagaggtgaaacgtggctgaagttggaagtttgaaatttgccgaagtttgaaatttgcagaagtttgaaagtaatgctatggggacattactgtttgggaaaaaaaatagtcctaaggatggagggattctacatccatcttattctgactttgattcttttcttgaggaaactgctctggaaacgaaaacctcacctctagacaagatttggggtcatgtcaagcagccaggtgtatcctcaaggaaaaaaggaacagacagctggagcactctgcttcagaaattcccagcagcgttaatgaggcggtcagcctcacacctgctgtaagaaggcaggcttcctcccatcaggtgcattgtccatgccggctagagaaatgtctttgatagaattcaaaaagccttaagatttataataaaaaagccgagccccagttgagaaattttcatgagcctaagccctgccatgggagcttattaaagaaacatactctcagcccctgagatttttattcagctgatttgggaatctgaattttcaatgagcacccaggtgattctgaaagcatgtgctccaagaattacacttagagaaccactgaattagcaaaagatataaaaaaggggggaagaactgacctaccttccttccccccacagatattttcttttaatttttatttcaatcatttttggagaacaggtggtttttggttacatggaaaagtcacttccacagctatttattgaaccgttgctatgcccaaatactttgctacataacagggatacaatggtatattagtttcctggggctgatgtaacaaattatcacaaactgaatggctagaaacaactgaaattcattctttcagagtttgggaggccagaggtccaaaatcaaggtgttggcagtgtcggttctttctggaggctctaacggagaaactgtttcatgcctctccccttgcttctggtggtcactaggaatccattgtgttctttggcttatagatgcactctaccaggttctgcctccgtctttacttcaccttctctgtgtctctgtatgtccttttctgtatcttataaagatattcacattggatttagtgccaactcttatccagtatgatctcatattaattcttactttaaatacatctgcaaagactctatttccaaataacatcacatactgaggttccaggtggagatgaatttggatggtggcagggagatgacactattcaacccacaacaaataatgaacctaaactgagctggtccctgccctcacggagcttatagtccagttggggagatagatattaaccaagtaatcacacaagaaatataaaagttcaactgggaaagtgctataaagcaaaggtgcatcatgctgagagcagccatgtgtaatccatcaatcaagtgctatttaatttgcccttactcttcatttttctaactattatttgttactaagggtgccaaaggaaaaagaagtataaggtctaatctcctgacttcaggaggctgacaatacatttagggtgatggggcaactataatacatattaaccaaatataaaataatagcctatattacccaatgaagcaccaaactgcatggtaatataagtgcaataagtattcaagaaggagcaggtacaggaagatgggtagatagtttttatttgggcagaagagagaagatttcggtaaaggtaaatattttaccttctccctgttgtaattcatcatcagcctcatggtttctaagagagtcatcaagacacaacaaatgcagtaaaccacacaagggttaggtgctacagcagtcattctaaaagcttggatggctggcttttactgccaccaaattcatggctttctagggcaataatttccatgtcctgcagctgtgctcttcgtaatattccacttaagtcaattaggggactttaaatatttgatctaattcaatactagccctgcttggtctgtgggtaggtctaagatcatgcctcacacatagtaagagtgtaataataaatgcttgctgaattatttaagtaaaacaagtctacttcagcaaaacttctctgtgtgtgtctctctcaataaaaaagataagaagaaagggcaggaaaaatttggagaacaggaaaagttctgctttcaatattctctatttatgttttatattcttttgttcactaattcaaatctacctaccatttatagatgatttaacaggccttaaacactttactagtgctttacatccactatcgtacaaacatcctgctaagagatgttattatccccattttacagagagatcattctgaaattgtaagccaaggcctcctgatcctaaaatttatgctaagctctctaggcgtctgtatctggggagggggacaactttcaacatatttaatgtcagtaactgtgtcaaatttgggcacagtaattgtgcccgaagaagtcttacaaacctacccactatcacagctccactgtgagaaccctattgttataatgaaacagattccctttacatttcttaacttggacttctggcttatttttccttccttttaggcctgtcttctaagatttttaacgtaaactttcctcatttagaagcctcgttcagttcgggtttgtcaatcttaggataaccctggttcaattcccttctatcctgaagtgcgaatttgtaatccccatattcctatatcccttggagatgaatagtgggcgggtctgaatcccaagcactgagaacctttaaggaattgtttcttaaggagatttaggggcacaagaacagaccacatatgttgagagcactaaataactcgaagacaacaaaggtcccattttgagcactgcttttagaaataacagcgtcttggttgcccatgaattgcttttcagtgagccagactgaccaatgttttgcctgaatgtccctcagtaagtctgcctatggagagtttctagagagaaatctgcctctgaaactaaactgacgatttctttcctgggcagtttaatgcagcctgttattgctatgctaatgtagcctctgttactactgaggggactttatagaatgctaagatgtgtgcgagctgcattctataaaccaattaataatatttgctggagtgcaaaagccatcaatctacttggcaactaacccaaccttaagcgcacagtggactaagaaaagataattagtgtgggaggtagactttggggaaagggagatggcagcatttgagcatcaagagttacccaccaatcttgtaaggaaataaactcctcttcaagaaaattatacactcagcatgtctccttaactatccaaagaagaggaattcttaaacagctgattccagaattctttttcactcagcagcaggaatatcccaatatggaggatgagtgcaagggcacttttagacttcatagatcctacaccttcatcatttcaaacatatccacattctcattaaatatgtactctgaaggtaaacatttttaaaaagaaatttatttataattttgctttcaaaaatatgtggccacaggtcactcatttaatttgtcattgattataatgtctcagaaatcatcctacattctctggaggacttgaaaattatttccaaccataacaaaatataataatgagtaaggttgtcataatgtttcattttgtaaacacgtaaatgtacatgtaagaattttgattttgcaattttgtttttgtatttggagacattttctttttaggatttgatcatcttagtaagaccttgagaaggttctagccccaggcattctatctgctggatgcaacagacagaatagccctggatgggtgccctcctttctcttcggttgatgactatagccattatgattttctactaaacgatcttgcttctatttaatgttttccaaacaaccccctggttgtaacttgaccattcaaaatctttcctacacgaatgaaatgtgctgagcaattaaatatggtactgtgtataataaatgtgtgtgcatataagcattactatctataaaatttattgaatggtaactatgtcaggcacgactttattatctccctctatatgtcattgtgctttataaaaataattgactaaagggaaaaaaaaagaaagagcagaggtaaagattagagaatgagaaaaatagagatggtggagtataatggcttagcattagatttctagagagagattccaaggttccactaccagatccttctctattaaattgcagtacaacctggggcaacttattaaacaccactgaactttgctttcattatttataaaatagaactaaacatagaatctagttcagataatttttatgaaaaataaagtaccagacaataatgaatagttaataaatattaatcattattttgaaatcagcttgaaaaattaacctgaaattggatctccttgagccttaatactaagcaacatttttggggccagatctgaagaaagcaaaaactttgtctaggatgttatcatacagtacactcaatgaagaggaaaatgttgacaagtttagcatttgggcagtctttgaattttccatgactccaatacttcattttgtttctgttgctttgaagttaaaacattttaaggcatttttcttcccttactcttttgaaaatgcaaaacattgaacaaaggaagaaaaataccctccatggcttagacattctagaggtcacagaatcttcaaagtttctcaattgtgggccagctgctctgctcttccatctcccaatacagaacagattttcagcccagaattcacaatgttcctttcatgtccttcattaaaggatttttgcatgatagcaactccagcttcatttctcttttttctcttttggccagtatcttatctggcagctttatcagttaaatattcattggtcaaattagaattcagccaaatgccttcctatttaaaatggctgggtgaatatagtgatcatttgtcaatgtccccttctgaattgttagtgagatagacctgaacacattatgtgagacagaaaatgaatagtttttgctgctatggttacagctagggtaggggtagttgtttacaagttatctttgttttcagaccccatacatgcacatacacgcttgggtattgaagtcctaaatattctagtaaagtatccatttcaaagattctatcccaatgtctctattaatcctcatatcattgttagattatttaacataattttctcttcaacagttataatttcatataactctcaaatgtgatatcacagatatcatatggctactctcctcaagcggtctgtgaattaacagatttttgcttatgttgaaaactcatttctcaatatcatagtttatttcctttttcttaaacagtatctgtttaaacaaaaataacataaggagaatagttcagcagtttatcagtttcctaatgaactagactcagtttcagttactgttgcttgcaagtagaactccagagctacagaaaccaagtctggcagattaagtgaaaaaaagctgatattaaaatatgtacagctcttccccccccccacccccagagtcattgggagggccagagaatttaccttagtcctgtttccaggaataacctccttaatcactctacagaagcagtctgataaaaacaaaacaaaacaaaaaccctgcctccatcaagctccagatgctacaatttgtgtctctgcttcttgaacaccaggaactcaactttactgcaaccacattgtctgccactccaacgccaaagttctatacagggcatcagtttgataagcaaggaagtcacaggtgatgctatccttgccaggaaatgagttctacccaatatgctagtcacttctaatttttattttttatttatttttctttttgagacagagtcttgctctgtcggccagggtggagtgcagtggcatgatctcagctcactgcaatctctgcctcccgggctcaagcaattctcctgcctcagcttcccgagtagctgggattacaggtgtgtgtcaccacacccggctaatttttgtatttttagtagagacgtcacttctaattttaagtctcatggatgtgtgtctgattggaggaaccaagttacctaaccacaccccagctgggagaggaggctgggaaatgagttgtctggcttttacaaggaggcaacactcaaaaaaaaaaaaaaaaaaaaaaacttccaaaaaaacatagtaaatgaccattataaatgcaatctgacgtgtatataatcgtcttttaaaacagtcttttagttaaaataattagttaaatcaaccagttaatctattcaagcaaggaacaagttttcttgcttctatctaaggccaattcttcttgttgtctacgatatccagcttctctcggtttcttaaaagctttgctccaaaagcacatcagaaatcttactcattttaccacattattttcaacagcatacagacatgctgctttctctcatcttaaaaacacacagtccgatactttcacaccttgccaccacttctccctccaggtagtgccctctcactactgccccactctgttactctttgcagcaaactcccagatagaagtgtccatatttgctgttgtccattcatttatttcattctatctgtaatacacttttattgcacgttggcctccactactctatggaaattgttcttgtcaagttcatgactgactttccatagctaactccaattgatggtcaattcctaatttttattatagttggactatcagaaatgttcaccctcctccttgaataacatattaatttggctttcatctcatcatacttttccattttgttatgttttgttttccatcatatgggccactttttctcagtttcctttgccttttcttttcaaaaccctaatgtctaaccattagagttcatagggctttctctcttctctgtctacacattctctcatccaggtctgtaagatgtatttatgtaaataccatgtacacaccgaagactccaaatttatagctccagaattttcccctctgaatgctaggcttatatatacaattccatgatatctctcttagaagtataataggtattcagccaggcgtggtggctcacccctgtaatcccagcactttgggacctgaggtgggcagatcacgaggtcaggagttcgagaccagcttggccaacatggtgaaacccatctctactaaaaatacaaaaaattagctgggcatggtggcacgcgcctgtaatcccagctactcggaggctgaggcaggagaattgcttgaacccgggaggcagaggtttcagtgcaccgagatcacgccactgcactccagcctgggtgatggagcaagactccatctcaaaaaaaaaaaaaaaaaaaaagtgtaataggtattcaaatgtacatgaacaaaacagaactcttggttcttaccttctagactccctctttctacatcttaaaaaatgtaaccaactgctgaggccaaaaatttggagtcatttctgactcctctttttgcaaaccctatatccaatccattaatatctgttggctctaacagcaacagatatccagaatccaaccttttcttatcaactccactgctaccaccaaatttaaaacaccatcactcttcacactgatcagtatagaagcttcttaacttgcttttctgctcccattcctgtatctctatagtgtattttccatgcatcagtgaaagtaatcttttgaaaatataatgattttattactactcaaaatcctcatcacatttagaaaaatcaccaaagtccttactctcaagagtaagcctgaggtgctgtgtagtttttagtcctctcaaacctcatctcctaacatttcttcccccatactcactttccttcggtcacattaccttaaattatatttaaggagggaaacatacaaaaataaacaattctgtctaagagtaatgactcaagcttaggatttaatgaaaatcaaggtgaggggattcaagaaagtggtcatggagaagttgacatttgagccatgttttaggaatgggtataatgttgaaaagcagagctcggaagatggaagacatggttggatgtgttatatcaacctaaataaactgagcacctactatgtcccagagactatggagtataaaaaactgagtgcaggtaggagagcctatgtatacctggggtatatatgttcctggttttctggggaatgctgagtatccttaatgcaaatagacagttgtctacaacagttaagggagaagaaaaaacatgatatccagcgagtgcactagccaatggcaatgcatagcttctcttcttccaccttcctccactctctcatcatgtttagtgctcagtaaatcaattcttgaatgattgtattaatgcatgcacacttaatgtgtgccaagtacaatctaagcactgggtacaaataattttagggttattaagaagtagaaattggccaggcacggtggctcacctctgaaatcccagccctttgggaggccaaggtgggcagattacgagttcaagagatggagaccatcctggccaacatggtgaaaccctgtctctactaaaaatacaaaaattagctgggcatggtggtgcacacctgtagtcccagctactcaggaggctgaggcaggagaatcgcttgaacccaggaggcggaggttgcagtgagctgagatggtaccactgcactccagtctggcaacagagcaagacgccgtctcaaaaaaaaaaaaaaaaaaaaaaaaaaaaaaagtagaaatttctccagtatcctcaatgggcttgcttacttagggtgataggcttaaaataattacagaaatatagaatgcagaagagagggcttgttttgggtaaaagaaagatcccgtagcactgctcaccctatgcaagtactgctcacccatgctaccatccaaatgcctataaagcacaattcttttgagctttaattacctttctgtctcctcactgtgccaccattgcaagtgtttccttcatgggatcaattaaaatactcacctcaaaaatgtgttttggcaaagagggtatttgaaacaatgaaaataaattacatgggtatggattgttggatgtcaattataaaaccaggtggtatagaacatatcatacattaaacacacacaaacacacacacacacacacacacacacacagagagagagagagagagactttgatatgctttgatgttttccaaaatttcaaaagtgtatgttcagtttataaggggccagtaaatattatttgcctgtctatttttaagagtgaaagccatacttagatatatcttagaaaaatattctaaaacacatcatatatagaagagggaaataactgcttctttttattcagtgcttactttctgccagacgtagctgaacattttatatgtgcaagcccaattaatttctcaatgacacagattaccaaaaaaaaaagatgcttaagttatgatttgccacgaagtagtgcaagtagagagtagacgacaaagcagcccagcatggaggccaatgtagaaaatgtgattcttttgtccttctagcccctcagctactctcccatgtcaggccttcactagacaagctcagagagaatcactagacaacagtggtcaggaggcctttacacctgtgtgcagagtggggagtggattagaaactgggagatgacctggggagaactgtgggaagtcctgctgtccagaccatctgggagaggaggtggagagccaccccaaagccagtcccatcccccagcattttctgtggcagactgggtgagaggcatggggagagtgtggagaggctggagcccagctgagaacataataacctctttcctttttatggatctgtaggaaaatatattaaggggtcaaaaagatccatcctacactatttaagggaaaaaactccttgctagagatgatccttaccaaataaattcttagaaattctttcagaatttcatattccttttctgattggtgaggagcagggacagggataatcttcagtttattctgtcacattctaaaatgtctgttactcagtgctccatgtagaagggatgtggttgcctatttgccctgactgggaaataacaaatttaacatgagattgacagtttaactctcctagacttcaaaaaagcttttctatgcaaagatatgggaaataagaaaaagtatcacctccagttttaccagcagatatattattgtaaatataggagtagaattagaataatccctctttaaattaaaatcctggttctctcttcttgccatccctattatatatttgtagcctcatttgtttctgggccaggaaattgtagcaaataccaggtgggagagaagtacacttttctactgtgcccatagcgagcgtaatgatggccgtcctctttgtccccagtggaagtcccttgataaatatcaatgaagtgatgttttccttcccagggaggaggtgatattgtgaacttgccactgtgatcattaatacttaacaagaccttctcttcctttaccaaagacagccctggggaccattcacaatgctttgtagtgaagaatgacattaaccttttgtagaggagctcacaggtctattagagaattcattatgcagggactggctagagaaggggtctgtatataatctcttaggcaaacaaagtgacttaattcaatatttgaggtgttaatagatcttctcacaattgtagtttaattgaacctgcccctgtcccaagtgacacgtggacaggaataacagagggtctacaaactggtcacaatacaatatggattggccagtctcaactgacaagccacattcagggacaccgactgagtacttcagtaaagcattaggtgctttggggaatgcactgatgaacaatggctggcaggagtaccctcgatctcctatgacaggcctcatgataaataccaatactgtgaaagaactgttccttctcggacactaaaatatatagaccatgcattcccatggaaatatctaataatctggaaagaagtgtacatttccctcaaatactatagacttgcataagcttaagtcctgtcacttgtgtagcaaataaattcctttctgattcacgaattcaactgtgactccaatcagttttagggaagaaggaaggcaggaataaaagttagcagacatcaaatatctaccttatcctgggatcacacagagatatctaatttaataaatgctggaatccagtgtggttcatattctcatctccatttcacaaataaagaaattgaaagcattcagggaggttaaagtggcttgttaaagctcacaccttagaaaactagaggtgtaaagtcagagattcacagccttgtgtttccgttgttcttcaacttgattttcgaaagtatggaagaaaacttcaacgatatctaatgtaaacagatgttcttatttctttagaaaagaagggttcacaagaagttgggtgttaacagcaggactggaaatttggcttggtgtacctagaaattaatcctaccctaacaagcaaacctaacatctcttcttaggcttttcacttttaaaacaacaatgatacgtgtaagaaatgaatgcatggccgggcacagtggcttacgcctgtaatcccagcactttgggaggccgaggagggcagatcataaggtcaggagtctgtccaatatggcgaaacgccatctctactaaaaatacaaaacttagctgggcatggtggcatgtgcctgtagtcccaactagtcaggaggctgaggcaggagaatcacttgaacccgggaggcagaggttgcagtgagctgagattgcgccactgcactccagcctaggtgacacagcaagagtccgtcctaaaaacaaaaaaagaaagaaaagcattaggtcatccctagttgttgtttgtttgtttgtttaatttgtgttttttatcaaaggaatgcatgtaccaagtttaatgtcaagtaatgcttaaaaaaaaaaagcttcccctcttccaaacttcacttctgctctccataggaagcacttctacctcttttagattttctgctactcactgtaatattgctacatagcatggtttactgctctatttttgatttattttattttagaacattatttattgagaagattgtgaataaaaatttaggttgccaacaccacacatacatgcacacgctttatctacctctatatttaaatattaattcattaagataaatttttgagacgtatcatatactcagcactaccataggcaatttgggaatacagtggtggccataatagaccaagttcttatcctcatgaagcttatattttaatgagagagacagacaaaaacaaacaaacgtatactatcagacagataacagctagggtgaaaaaggcagggtaaggggatacagaatggcagacagaaagtgatggtttcggtaggataatttttgtttaaatcaaatttcaatgtttaaattattttgactgtagatttattttacactgagccatatgcatgatgactacatttcttgtacaatttttgttttctttggaattaatccttgccttggcaagagagttgggtggggcgttggtttgcctctctttctattactgaatcatcagcagagtctcttccagggtataaaaacacttctcacaaggacccagcaagcaagaaacctaccagttccacatgttgcctcctgctcgcccagattgtcattttgccgctttcctccatcatcatcttgagaaatctttttgcctctctcatgtgccagatcccctctttctttatctcatcttcctctcttagtttagtccctccctttgatgggacacatctcctccagcagtttcctaagaaaaggtgcatgggtggcaattttattctgcatattttgcttgaaaacatctttattctaccttcacacttgagcgttaatttctgtgggtgaagtatcttaaattgaaaaatattcttctttagaattttggagacattgctctgttatcttctagcttctaatgttgcgcttgagaagtcaaatgccattttgaatttttaatcttttccgtgcagactttttttttttttcttcactaagacttttaagatggtttccttatcactggttctgcaatgttggaacagggtgcctggatgtaaatacgtcatcaccaggtcctaggtactcaaaatctgaaattcaggtccaattctgcaacatttcccttgtatgatgtttcccctcttctgttttgttttgttttgtctctctttctagaatgcttatttgtcagccattggttctcctgagttgattcctcaaattcattgtctctctctttcttccttctttgttctctttttgggaaattttctcaactttatatttcaccttttatattgaattttccccatatttttaattttttaggaaagttgtaagatttgtatagtaaacacgctcttacttttgaattttaaatgttcccttattaatttttaattttcaatatatttttatagttctctgggtatttctacatatagcatcctggtattccttcatggatgaaacattttctcttatctctgaggaatttttttccagctttcttctactctttgtctctgcttcttcaaggctgcttatgtttttctccttggttttcaactctttagtgttaggcactttcttcaaaggtctgctgatccttggctatttgttcacattaacagtaaagaatggctgcagagatatagtattttcccatgcttctggaaatcatccaaaaataacaaaaagaacaggaaatattgaaaacaacaaatttcaaaatattgaaattttttgtaaaattaggcagcagactccaaaatattttcaaaggcagccaaaatagctgactttgcactaaaacctcctaaagataagtagaaacaagcagaggagaaatttcagtggaaagcaaatccaccaaaataggtcctaagaactggccacagaaaatattatctcctgatggtaagcagaacatgctgaggggccaaaactatattccttgatttccagagggtctggaagttgggatgagcaagataagaacaggatcctccctcctcagcccttttttttttttttttttttttttttttgagacggagtctcgctctgttgcccaggccgagtgcagtggcgcaatctcggctcactgcaagctctgcctcccgggttcacgccactctcctgcctcagcctctcgagtagctgggactacaggcgcccgccaccgcgcccggctaattttttgtatttttattagagatggggtttcaccatgttggccaagatgttctcgatctcctgacctcgtgatctgcccacctcggcctcccaaagtgctgggattacaggcgtgagccaccacgcccggccagacctcagcccattttttaaagagaggcaggggaggcaggactatctgaagtgtcacagaaaaatcctattttgaaggaatcaaactatctcgctgataactgagaatgtgagagccttttgttagaaaaacctactagcctggaaagctgcaaagctgccgtggttcttccacattcctgcaaattactggtctgggaaagcaaactcattcaaagacaaatacatatgtatatacatctctccaaactaaatatgtatgtgtgtatatatatatacacacacacatatatatataaacacacagagaaaatattatatcaaaaaattagaaaaagaaaagcaaaatttattaacatttaaaaattccccccaaaaaatggtgccatggagaagctgagaattctaaacatcctaacccagtttgagacagtaatcttggcttcatctgctttttggaatcaaactttcctacaggtgagctgtccctaggacttgaccgggagccaaagaattgggcaaggaatagtaagaagctcttttggtcacagatttaaagctgtgatctccaatcagcttatccaaactgaaaactgacattctgatgcccacttatcattttcgtatgccttatttctcagttaatttggatgcaggaaaataaagttggctatttgttgtatgtaactaaataagaaagcttaatgtgtaatgtaataatattggagggctgccccaataaggaatagtctttcttgctccttatgacatgagtaagactgaaccctgtttaagtcctgccactgctctggtctgtatcctgtttgacagaatgagatgctgagaccctagctggcccttagctgcccccctccacctttgatatgcaatgtaatggcttagaacaggacactgatgacaacctcagccacctctgctgagacagaatggcccagtagactcttctgctgtcaaaggtagggggttgaggagacaggggcactgtgtactatttcttctctctttgtccattggacccaaatacatatgtttgtttcatttttaaaagtctaatgctaagactggtcaatcccattgattcctgcatgtgagtatagaaggactgagatgagaagcgtttactactacgttcccagtattgcccagtagtattccttaatgatcagtcctggcaccagtattataggagcaacaagaaaaagatttttgaaaataacttgatatttacagaaaaaagtattaatatcttctttgtaggaaaagtaagacatttgttttattttgaaagacttatgagtagaatatcatactcattttagtgagtatggcctgaaaagatcacaatcaaagtagcctatatttccccttgtctgtaattcctctagctaaaccagggagccaattttaacagcttgatagttctgcttctgataacaaatgggggaggaaatggcactgtgatttatatattccagccctatgtaagtgaattagtgtgagttagccttcttaagtcaagaagcactttctgagtggatgtctgaaggcagaccctacctagacaattggtggtatcaccaaagcaaaggctcccgaagaccctccaatcttgatgcctagtttccactcaaacaggacctcttattgtacaatggcagggagaaccatttcatgattctctgtgtaaaagggactttgaatacttaccttgtaactggtgccccgtgaagttaccacaaatgggtgttaacagttgtaatccttttgttttaggaaggtggaagtgataatttaggtcctgaaagattttgattttagctaaaagaatactgggctgtgtatgggagaacagtttttaacaaactgtgcaaccgtgattaaataacttttcttggctgcagtgatcgcctttacagaatgagaaaactattagaggatcatgaactctaggagttagcgctaagctttatattctttactatacattttacaggtcattgctcatgatcccactatttgtcattttattaattccagggaggagcctcttcctggttcctgatgagaagcttctaccttctctctgcagggcttctaccatttatgtggttccatggcaaaaaaacaaaaacaaaaaacaaaaaacaaaaacaaaaaaaacaggcctagaggtagttagaccctggggctaaggtaggaactgaggcaaggaggtgttccgagaacagatgccagaggactaacaccaaacacctccttgggaaggaaagggctaattcaataattagtcaatggaaggcatgtgagagcattgcagaaaaacaatgatcagtgtactgggagagaaatgggaactaggctaggagagagtacagaaaggagcaggagaacacagttggtaccaatggagaggcttgcagcaggcattaggccttcccagcacgcagcctgctaacagctgcgttcacttaaaggggcaaggatggagatgctacattgcatggctctgtttccttaggacagtcccagagggataggatataaagaaaatgtcccagaggctgggaacagacagaacacccagacaagcaggcatgggggaagcgctggcccacattcctcccagctcagctgggtgctctgccttttcactgccctatgatcagtgtgaggaatgttgactgtcctgtgacactgtgcgggagagaggtctctacctccatgggtcccaccctgatgcaggcctttaaaacagggtctggcagaatgcatattccctccatccttctcatcctcaatactttggctcagtggccccaaaccaagtttctgcccctggctccccttcttcgagttacacctcacctgaactgcccaccttgctcccactggcacaatctctcgggtcagctcctatcagatcaaatggatgtgtttatttttatatgtatcatctctccaccaaccagattaaaaattccttgactgcaggaaaacttgtcttgtttaccgtaggatttctagcacccagcacatattagggagaaagcaatgatttgtggcatatggaaaggcatcagccttcatgctttgtgactcccctcttcttccttgctcaccagaatccgagaccccccagtatcactccagctcctcagttccctttgcctggaaaaatgaccagcatctttcccatttttctagtggaaacttagttaaataaaattattccagtatattaaggaacttgcacactggaagggcatctcatcatttggttaaccttccacagataaaggtatcggctttgtcagaccattgaccttgggggtcaggttacaaatcctctggaaaaaccccaaagggtaagtaagaaagtttttacaactttacagctggctgggctccatttccagagatctttaattaattgatttgaggaaaggccatagtgtttccattagttccctggattctaattagagccatggttaagaccctcaagacttagcagacctcggtctctgctgcggtgtctgagccacggggcaatggaagaagcacaatgggtctcaggtgagtctcctcagccttcaccatacactcagaccccatgagcgagcacacgccggagtaacctcggcgcagccaagaaaaggtacggactctctgagatccaagatccttaacctgaggtgtggcttcaactccactaaaacatattctgatccagcaatctctacaacttcatcacaaccctgaggggtgaaaatggaggcttcgtcattttatttgttcaaatttattctactaagtgatacaactggaaccaccaaccaggtatgtctgaccctaaaggctgtgcttagtcttttattaaagactgagctatatacaagctaaaccttcctaatatctttttagaaaactaactggtaaccaataggatcttctgagtcacagctgggccttcaagcatgcatgccagggccactgcctctgaaactcaaagtcaagtcagatctctcacaaagaaatccacatacctggaattttccttgtgggccagctctccctgtcttcaagcacggcccagaaggacctgccttgtgattaagcctggaagtgctgggcttgaagggacttggcaaccatttgtttccttaatgcccagctataagcaacagagtttatagttgcagatgaattttttctcttattgcaaatggctttgatttaataataacattttccaagccattggcccataatgaggattattgcctgtgggtatttaatacaggggaaaagaaatgggctcacttcactatgcaaatggctgccacaaaccctgcagcaggagggctcatgtaacctttttactacaacactgtctggggctgtggaaagatgcaggcagttaacgtctcttttcattgagccagagttcaaccaagtctcgatggataactttactgggaactggctttcaaaagccaaagtccactttattctggtgccctatgcagggtctgaaaagagttgttgagtttgcaagctaactcagaagagatggagccaaggcaaggatgggtggtgaagggggctaggatgggcagggaggtggagggggctgtgctgaattttgaagatgaggaaatgataaaacaatgccagatgcagaactagggctttctctaatgtgatctcacttaatccttttatcagctctgtgtggtagatatgcctatttgatgaggaaactaatgcttttgagatgcagaggaacttttctcagtgcaaaaataaaaagcagagcatgaattccaacgcaggtttgtctggcgtggaaacctatgatcttactgctgtgcggtgtggcctgtgtgcatctggctgtctgcttatggcaaggcagcctcaggcactcattggaagctttctgctgttctacataagcatctcctctttctgaaccctgaagttctcagcactcagggccagttgctcagctgtcctgtctcatgctcctacttggaatgggcttcctagcaggcctatgttccctaataggagtttgctgggggtttctgtcacctgaaggtactgaccggttaggcgttgtctaattctgtgtgaggagaggcagctccccactgtactggacagaatggcagagaggagtttgaggaaataagacacatttctaagtttctaagggagagctgccagctggttaaacctgtctccggtaactagctttctctgtggaggcagtggggtggtagtagtaattaggagtagagaggagggagttaggaagcaagaaagaggaaatggaaggcttgaggcctggggacacttcctctttatctagccatcactgaagggtctctgcctcggcctccaacttccaccccttgtgtgtttaccggttcacatttactttgtgggccaagaagtgtgtcaagcatgttatgtacattaactcacctgctcctatgttaatcctgggaggctgcccttattattatacccagtttgcagatgaggacattgagatagaggctgagtcacttgccccaggtcatgcagctgatcagtggcagagtcaggaccctagacagggggcctgactctcagtcaagctatccccaggctcgcagcactgcctgttgtgatggctgggttttctgaggccaagaaatcctgccaatatcccctcagtgttctacccagaccacgtccgcctcccttctctgtcagcgtcacgcacagcatctttgtctcagattgcttttgtcactggatctcagcattctgtagagttctaacctattttgtggttcctgaagtggttttgaagcgatatttaaaatgcaaaaagagaaattcaaaagcccccaagtgctgtcttaaaaaagattacaaaaacatcttctgagcttggtcacaagaaactgatggtagagtctgtgtaatctgttgacaacatggtagagcttttattttttaaaattcttcccctatgttgtgattcaattttatgaatgttttcagatagtgtcctttttatttatagtggtaataccacccttccaagtgcaaagtttttccatctgtccagttatctaataccctccggggccctaactgactttgagccctagcaggagtgctggcaaggtggtccatgctgaggtttggaaaggatatttgtccggtggccagaagtgtaaggagccagagggaaaatgtcaaatatgtcctgtgagtgttgaggactcatagcctagtagccaaagcagtcattgagtccaagagagcaaaggaaagtggtagaagaagaaggtatctagaacaggagatgaaggcaaagaaactgctagatattggaacagaacagtatatgcagaatgcaggcaaggagaccccacagccattgccctgtgtggagcatagaacgctctctcatttgtgcaagtcacatggtgtatgcatgtgtgcttatgtgtgacttaagtccagcttcaaacaacaaaaaatgtgacaaagtcaagctgttcagaactgtgtcagcaactggatagggaatgctgtctgctgctcacagctgaaccaggaagagggcagactgtgggccagaagcagcacctcttctacagccatgctgaggaattttccagttatccctccccagggtgtttactgcccgggaagaatgaaggtctgacaagttacagttgctgcaaagcccttcctaggcaagtttgatcagaagagtcaggaagtgttcctttcactttggaggaaggttgaataaaactgcccaggaggtgtcagtatctaaggctcacacgaacaaagagagggagcccgactttgcaatcaaattgggaaggggtttggcacacaattactcaaatgtcccaaaggccagagaggtctggagaaacaagggatgcatgtcaaaatcttacttctgaccttcaaatcccctcccaaattttattatcttctatttctgaagctcctttttatctgtcacatagtagtattacattaaattgtctgtattgctgtattacattaaattatctgtattgctggccgatgattgcaatttgccctattttctctcagtctacctcagtggcgtcttcttcatgcccgttaatctttttttatgtaaaaaagatttacatgtcagctggggccctttccccctagatttctagacctccttgattccatcccattatgtaacagaatccaaagtcctcccatgggtgtctagtgagtcctgagggcaagtgcccccactgaagagcattcatggtaaaaataataataataataataaaataaacatctcttcttgccaggccataaaataattagttggctcttaaaggtgtgagaaaatgtttcagatctctaacgtacagacttgatcaaaggagtttttccaacagcgtttctcttatttttcactcaagagaatatcaagtaataagatatttcctatcctgatttgtcaagcctctgctagggaggcttctgtctttgctttagaaattcaaacagtggaggcttatctctcctgtatcaggagggtgcagtattaacaggagcatgaagaagaggccattgcggtagaataagagaaaatacagcaaattgcaatcactggccagcaatacagacaaaaaggagttagtcgacatcaaagccgacagtgcaatatacagtcaaagctttagacaaaatggtctgcttccaaggtgagcagactccattttttaagagtcaagatgattaacaggagtgacatccaattataatctttccttgctatctgtgtctctgaaatgttgacttcatattttttaacagaaatattacaaaataatcaacacaaataatactccaggacaaaggaaaagattttttaaaataaactcatggaatatcttgtgtttttcttcttttcctttgttgtaagctacataagttactgtactgttctaagcttcaaaaacactagcaatgatttatgaagtccgtcatattttttcagattaagaaagggtttttatatagctgaggttcatggctatggactttgaggcaaggtttcttcaggcccttggcttctctgtctttggttttggtatctgtccatgttatctctaattctttcattttcaacctggggtaagaaatgtagatcattcataaatttccataagaaattttttcacataacaggaaacataatcttccaccacctgctaactcccttcatctctttttctctatatgaattgctgtcttggaattcttatttttttcctctctattcagttattggaggtttgccttgttcctgcaccaagctttagtacccactccctcaagacccacagaagcagcaagagtcctgtccttaatgtaacccttctcctagagggcagtcaagattataacagcaacatttgtgtattgcagtaagtttgctcctgcatctttcaacttcttgctcttttatttctgctttaaatgcaagtcctcttattgatcttcaagacctagaacctgccaggatggagaactgcacaccatcttgggtctttaattgaaaagtcatagcaagggtgagattacctggaataggaatctgccagagggatttagttgctatgccagcaagctatactgtgtcatttttgtcatgctgttactgcatcctgggtagaccgaaaagcctctcagttgtctttggagctaaacttttcttaattgaggggaaaaaaaggtttctcaatgcttatctgacacagctggatgcaagagggtgctaatggaccagcaactgcctcaaatacattttaattaagtgatttccaagaagccatgtgcaactgagataagactatgaaagaagtccagaagctggaaggaggttagagagacaacaaaaaagggtcaatgtgtaggtcttatggggagtaatgaagtcaggccttgaagggccggtgtctttcaaaaaattctacccagggcttgctttttcttttctatcctacaggcttggtagaagtgaaaattgctactcatttatgcaagcagtagagagtagctgcgtgctatgaaccaggataattcatttattacaaaccaacatatattgagctattctatggacaagtcctatgttggacactgttacatgtgcaaggatgagtaagcccacccctaacctgtaggagcttccagtccagcagatagacagatgaccaactaactatagtacaagacataaattgaagtagataggaaaatagatacagtaatacagagcagggaataaccaaatatttcattattaccaagaaaatcagggaaacttaaaagaagtgatttttttttcaattcagctttaaggagtaaatacatttcaaaatgctcagaggggtgagaaggtaattcaagagagagctgtaaaagtatgaaagaaaataccttttgggggagggctaaggcgttaaatatacagaaacacaggttgtgcagaaggaccctaggagataaatttgaaaagatattttggaacttgatgaaggtcttaggagtttagactttttcctctgagcaatggaagagccatccaaggtgttaaggctgaacttgataagaactgtattacaataaatcacactggtagcagcatggatggaatgggattgtatcagaggcagagaggctagcatagtgtagaggctctcattctgcaagtaaaaaataaatcatctaagaattaatgaggatctgagctgaaattgtgattgtggggatgaagaggaagagagcaattgaaagtatatttttggaataaattggcagggctcaggaatgtggtagaatgaagaagataagagaattcttgcactctctggaaaagctttcagcacaaggagaatggagtttagctttccctatactggatgaccctcagtaataattaaggtatttgaatgttctgtccttaacacctgagcttgataaagaacctactttcagttctttgatctgtgtgtaacccagcaatgcctctcatccctagtgttcaaccgagtttatagtctttgccagagaaaagaaagcatcattagagaaacaggccaccagtttcttctcctgacacttggatacttcacaatgtgagttaaatgattacttacatgcagtgattttacgtggtacaaaattaattttacatagctcacataaaaatgggtggtgggcatacagaatagggaaagcagagatgggaaggcggaggggaacatgctctcttgtttaatggatagttctggtaggcagaggaagtatccaatttggaccatcagccaagcctaaaatatcctcctgcccagcacctggcctctttggctcttttcaactgtttttggaaattttggaaacataatttggctggtatgtttgttgtagagctctgcctagggtcaggtcccagccatcatcactggctgaaacagaatgtgaaaggataatacccacagtgaaaaatatcatcagggactttcatgacaggttttagctttttttttttctttgagaataagtaaaagcaagaaataataactttatggactcagcccacacagcacataatcagctagagaaaggccatccttggaaatgcatagatgttatttaatttttgtgtttaatttagagggatctcaaggaaaacgaaggtatgtcaggatggagaacagcacaccatcttgggtctttgattgaaaagtcatagcaagggtgagattacctggagtaggaatctgctaaggaggacattctatcaaaggatcagtttacctgaaaaatctccttactgattaaaattcttcttattccctactttctatgtccttctctaagcatcacatctctagatgagtgccatttttcaaattcagtgtgcataagtgtcatctgcagaactcaatataaacctcaaagattctgactcagttgatgtagagttgggtccaggaacttgaatttttaacaagcacactaagtgaatctgctccttctttgcagttccttgccctctatttggaagctcatggtgtttacattataaattcctcttttctggcatctgactttccctgtgatggagaacagggagtctgaataggaaagcacagcctgccatgagtacattttcaggctcgttaagtctcatattcatttgccgcaaggaatgagaaaagaagagagagcaactaaagactgcatgtttcaaacatgggtgatcatcatttctcctggggtaacaggctccccttggagaaagaaattacaaattactaatagatcatatggcagaaaattgcaaattccaagcaaaataaatatattcttccatttctagagttttaaattggctataaggtaggagggtgcagtattaataggcagctatcaaatagaacagtggtgttaaattacataatcaatttaatgttctgggtcagttgacaaagaaatctgttctctcactgccactaatttagagctttcaatatcccattcacaagtctttttaaaaaacttttgggaaagattttggtatatcaaattcttccataaacatctgtaacagctgtgtcagggatcccagactagctgacctttctccttttgcagtctgagggtggaaatgagaacataatcgcccatgatgagctggctgagcaaagttgggccaagccatcaaatgcagctgttgacttcccacaggattgatctctcttgcctcacagttcacttcaggaggaaggtgtgtagaatatgaggccacatgtcctgtgtgagtgtgcatgtgtgtgtgaatacaagcacacatgttcatatccacatgcatccagggtgagggggatgacagggatacagaaatttaaagtacacattatttaactttggagctaaagttttttttattggaaagccttctggctcttttgctctagacagtggtgaaaatgtgaagttccttctcaagtagctctagcaagtaagctttatctcacgtgccaactgattggtaagtggttctctgaagccctgttttgagaaggattctgagaaggaatcaggcttagccagaaggattgattgttggtgcatcctattattccagagtggaacatggaggtgtacattgcaaccttggggaaggttgtacctacatgcttcaagcaaatgccatcatttaaagagtaggactggataagcacaagtctttaggacatagtgttcattctggtgcccatgctcaaaatagctagatgttactcagcacatccattattcaactatttatttagtgtatattaactaccaggcactgtgctatcccctggaactacagaggaaaacaggagagccaaaactgagagctgagccacagccaaaagctgagtaagccaacaaccagtgaggtcacatcaggtctctgatgggtttaatgtagtaaaatccaccccctgagtaagcatatagacagaaaaatcattgattattaaatacatctttgtttaatgaaagtctgcatgtatgtttgttaatatacacgaatgaattaaaatacctgcaatggaatcaaaagtgggcatggctgtgatgtcctcagatatcctgtccagtttgggctcaggtccaataatgtgaactaaaaagatcttaaccattgcaattcatcattctgaaaggcttaggggcagaaaattccatttgctgctttgatcatattttcaattccaaaagtttcccaagtgaaacaaggcatagttggttcaacaaggagaatggtataatgatattgcagttagcagttaggtttaggagaaaaaaaaaatcaaaagtttttgtaaggttaaagacttttggggaaaaattcactcctacaatatgcttgtttgttcagtatctaattcttcacagtcctgttggcagggcatcaaaggagtggccctatggtcttctcaggcattctgatggtgcaggcaatattgattacttttctatttgaaagatagggaaaatgtgaaaaccaagaccacttccttctgctcttcaccataaattggtatatacacagacagcagtcattaattggctgaatctgacagatttaataatttaattctgctgcaaaaacaattattcaacttttttctgatttgttttttcttttagtttcctcctgctttatattatatatacttcagctcttctctgctaacacatatttaaaagactattttattttggaggcttaagtgcataacaatggtcccccagtcacatgcttagttgccatagaaatagcttctgtgtgttgactatctccatacatcaggtactatggtaggcaggttagaagaaaagttgttcgcaacttcatcagaaactttttgcataatttaattcacagtgttctctgggaggaaaattttattcccaataaaatgtttaaggaattttctcatgtgctttaagggtaatcagttgtctacccagttgactgtcagctgcccatcagttaagactctagtgactttttttgaaagatgttatttttcagaacagttttaggttcacagcaaaactgagggaaagatacagagatttcccatatactccctgaccctacacatgcacagcctcccccattatcaatatctctgaccagagtggtatgtttgtcatagttgacaaaggtacattgacacattattacccaaagtccatgtttacattagtgttcactcctggtgttgtacattctgtgggttggacaaatgcataatgacatgtatttacctttgtagtatcacacagaattgtttcagtgccctaaaagtcttctgtgcctgccaagccatctttccctctcccttagcccaaccattactaactgtcttcatatttttgccttttccagaatttcgtatagttggaatcatacagtatgtagcctttttagattggcttctttaacttagtaatatgtgtttataggttctctatgtcttctcatggtttgatagctcatttctttttagcactaaataatattctattgtctggatgtaccaccatctattcacctactgggagacatcttagttgcgtccatgttttggcaattatgattaaagctgctgtaaatatctgtgtacaggttttcctgtagacatatgttttcaactccttggagtaaataccaggaaatgtgattacttgatcttatggtaagagtatatttagttttgtaagaaaccattaaactgtcctctaaagtgtcagtatcattttggattcctaccagcaatgaatgagagttcctgttgttctacatgcatgctcaccatcatttggtgttttcagtgttctgcacttcggtcattctaataggtgtgtagcagcatctcattgtttttatttgccctggtgacatataatgaaaagcatattttcatatacttatttgccatcttttatattctttggtgagctgtatgttaaggtctttggctaatttttattatccgttgtttgttttattctgttttactgttgatttttgaaggttctttgtacattttggttaatggtcttttatagaatgttttttgaaaatattttcccccagtctgcgcctttaaaaagaaattatcttgacaatgtctttcacagagtagaaaattttaataaagtccagtttatcaattttttctttcacagtccatacctttggagtcttatctacaaagtcattgccaaacctaaggtcatctagattttctcctaggttttcttcttggaattttacagttttttatcatttacattctggtctatgattcatttttagttaatttttgtgaagggtgtaagatctgtatctaaatggatttttttaatgttgtttttatttgcacgtaaatacccaattgttccagcaccatttggtgaagagactgtattttcttcactgtattacctttattcctttgccaaagatcagttgactacatttatatgggtctgttgctgagctctctattctgttccatcaatctatttgtctattcttataccaataccataccatcttgattattatgggtttatagtaagctttgaagtctacttgtgtcacttttccaactttgttcttctcctttagtattgtgttggctattcttgaacttttgcttctacaaataaactttggaatcagtgtgtcaatattcacaaaataactttctgggattttaattgggattgcattgagtctacagatcaagttgggaagaaccgacatcttaaaaatattgagtcttctggccgggcgaggtggctcacgcctgtaatcctagcactttgggaggccgaggtgggtggatcacgagatcaagagatcgagaccatcctggccaacatggtgaaaccctgtctctactaaaaatacaaaaattagccgggcgtggtggtgtgtgcctgtagtcccagctactcgggaggctgaggcaggagaattgcttgaacccaggaggcagaggttgcagtgagctgagatcttgccactgcactccagcctggcgacagagtgagactccatctcaaaaaacaaaaaacaaaacaacaacaacaacaacaaaaattgagtcttcttatccatgaacatgggacatatctccatttattcttaaatttctttcatcagagttttgtagttttcctcatatagaccttgtgcatattttattagacttatatgagaggacttcaaatttttggttgctaatgtaaatagtatagtgctttaaatttcaaattcctcttgttcattgctgttatattggaaagcaattgacttttgtatattaaccttgaatattctacaagattgttataactgcttattagttctaggagttttcttgttaatttttttagattttctacatatacagttatgtcgtctgtaaataaataatcttaatttttttcttcccagttggtatctcatttatttcatttcttattgcattagcttagattaccagtactatattgaaaagcagtgagaagaaatattcttgccttttccctgatcttactgggaaagtttcaagtttttcactaatagtgaaaatgttagtgtatagcatgatgttagctgtgggttttttgtagatattctttatcaggttgaggaagttggcctttattcctgtttactgagagtttttactatgaagaggtgtttggttttgttaaatgctttttctacatctattgatacaatcatgtggtatttcctctttaacatgttgatgtaagttacattaatttattttcaaatgctgagccaggtttgcatactgggataaattccacttggctgtggtatataattctccttatacattgttcgatttgatttgctaatatttcattgagggtgtttgcacctgtctcatgagagatattggtgtatagttttctttccttgtgatggcattgtctgccattgcaataatttctttttaaaggcacagactaggggaaaatattttcaaaaaacttattctataaaataccattaaccaaaatatacaaagaacattcaaaacccacttctgggcctggtgctttctgttttggaaggtattgattattgattcaatttttaaaatataggcctatttcttcctgtgtgagttttgacagattgtgtctttaaagaaatcagtctatttcctgtagtttcaaatgtgtgggtgtagagttattcatagtattcttttattatccttttaatatttatggggtctctagtgaagtcccctctttaatttctgatattagtattttgtgtcttctccaatttttttcttagcctggctacaggcctatcagtattattaatcttttccaagaaccagcttttgttttcattcattttccctattgacttcctgtcttcaatttcattgatttccgctctaatttttattatttatcttcttctacttgctttaggtttagtttacttttcttttcctagttttctaacatggaagcttagatgattgattttagatcttttttcttttatgatatatgcattcaacgctgtaaatttctaagcactgattttgctgctttccacaaattttgacaagtttttaaatttcatttagaccaaaatactttttaatttttcttgagattttgtattttgctcgtgtgttatttagaactgtgctgtttaatctctaagcattttgggattttccagctgtctttctgttactgatttctagtttaatcttattgtagtctaagagtagatgctgtgtaatttataatatttcaaatttgttaaggtgtgtttatggcccaaaatgtgctctatcttgttgaatattttgtgtgagcttgagaagaatgtgtattttgctgttgttggataaagtagtgtatagatgttcattatatccagttggttgatgttgttaaattcaactatattcttactgattttctgcccactggatttgtccattcctgataaaagagtgctgaagtctctaactataatagtggtttcacgtatttttctttgcagctatatcaattttgcctcacatattttgacactctgttgttaaagcctaatgactgttaacaaaatatttttgtctctttacatcttgcttaacagtgagtgtgtaactattcccttgtcgtataacatgttactactacaagacaatattcaaattgtcccaagaggaatatttttccccttgtgtgcaaatatgtagtagaaatgtgctcttaattgactgaatactttagctagagagactttatacacattgtctcttgtcttcttaacgtcctattgattatgttatctcatttacttacgggaaaagtaaggtctgggaagtttgctcagaaaaacatagctaataagtagatgaattcggttgaattcaaaaccctatttatgtgattctaaaatattttccaaaatgcatctccatctcttttggtgggttgatggtttgtgtattagtctggtctcacactgatgatacagacatatctaagactaggcaatttacaaaataaagaggtttattggatttacagttccatgtggctttggaggcctcacaatcgtggcggaaggtgaaagccatgtctcatgtggcggtggacaagagagcttgtgcacggaaattctcttatttaaaaccataaatctcattagactaatccgctatcaagagaacagcacaggaaagacttgcccccatgattcagttacctcccattgggtccctcccacaacacatgagaattcaagatgagatttgggtggagacacagccaaaccgtatcattcagcccctgactccccccaaatctcatgttctcacatttcaaaacaaatcatgccttcccaacagtaccccaaagtcataactcatttcagtgttaactcaaaagtccacagtccaaagtctaatctgagaaaagcaagttccttccacctatgagcctgtaaaatcaaaagcaagttagttatttcctagatacaatgggattacaggcattgggaaaatacagcccttccaaatgggagaaattggctgaaacaaaggggctacaggccccatgcaagtctgaaatccagcggggctgtcaaattttaaagctccaaaatgaacccctttgactccatgtctcacattcaggtagtgctgatgcaaaaggtgggtctccatggtcttgggcagctccacccctgaggctttgcagtgtacagcctccctcccagctgctttcacagcctgatattgagagtctgtagctttccaggcagacggagcgagatattggtggatctacattctggtgtctggaggatggtggccctcttctcatggctccactagatggtgccccagtagggacactgtgtgagggctccaaccccacatttcccttccacaccaccctaccagaggttttccatgaggaccctgcccctgtagcaaacttcttcctgggggctttcaggtgtttccatacagcctctgaaatctaggcagaggttttcaaactccaatccttgactgctgtgcactcataggctcaatgccacatggaagatgccaaggagtggggcttccaccctctgaagcaaaagcctgaactctaccttggctcctttcagcctggctggagtggctaggatgcagggcaccaagtccctaggctgtgcacagcatggggatcctgggcctggcccacaaaaccattttttcctcttagacctctgggccctgtgatgggaggggctgccatgaagacttctgagatgccctggagacattttccccattgtcttggggattaactttcagctccttgttacttatgcaaatttctgcagccagcttgaatttcttctcagaaaatgggattttcttttctaatgcattgttaggctgcagtttctaaacttttctgctctgcttcccttataaaactgaatgcctttaacagcacccaagtcacctcttgaatgctttgctgcttagaaatttctttggccagataccctaaatcatctctctcaagttcaaagttccacagatctctagggcagaggcaaaatgccgccagtctctttgctaaaacataacaagagtcacctttgctccagttcccagcaagttcttcatttccatctgagaccacctcagcctggaccttattgttcatattattatcagcatttttgtcaaagtcattcaacaagtctctaggaagtttcaaactttcccacgtttttctgtctttttctgagccctccaaactctttcaacttctgcctgttacccagttccaaagtcacttacacatttctaggtatcttttcagcagtgccccactcccagtactaatttactgtgttagtctgttctcacgctgctgataaagaaatacctgactggacaatttacaaaagaaagagttttattggacttacagttccacatggctggggaggcctcacaatcatggcagaaggtgaaaggcacatctcacatggcagcagacaagagaagagagcttgtgcagggaaagttcactttttaaaacaatgagatctcatgaggcttattcactaacacaagaacagcatgggaaagacctattcaattacctcctaccgggtccctcccacaacacgtgagaattcaagctgagatttgggtggggacacagccaaaccatatcaggttgtttattctaatttccttgggcattttgtgcttttcagatgtgcaaaggcctgcttcagtttctatagtaagtaggcctaaatggtaccatccatttcacatggcaacatgcatcagtatttctgatgtctgtgttctgggaggccacacacaggtgcttaccctaaaacatagagtctcttcctctctttgtatgaggaacacttatagctacagtctattgagtaaggtactctatctagattatgtccttgaaccctattacagaagataataatgtctactatattgtaaagtagatattatttccccttttatacagtggaggaaattgaatttcagagaattagattaatgtgcccatgcatacaaagctgctaaaagctgagccatatgcttttcttcagtgtatgaatgaagaaaagaaattttagtgtttttcccttttttcccgtttaacagcacctttaccattctgccttctgaagttaccacaatgatgccatttcttcagcaggtgaaagccttctttgtttttgttttgtattgttttaattgttttggattcattcaggtttgttgcatgagtatattatacagtcttggtgtttgggcttctgtggaacccatcacccaaatagaaaacatagtacccaataagtagtttttcaaccccttctcctcttctaccccatccccttctagagtccccagtatctatggtttccatttttatgtccatgtgtacctggattaattcatgtttataattttccaagagagaatgtggctgtcctttgaaccacacctctttcattccatctattttctgtctcttggaatacagcataaccatttctgaaaagttctccctcactttccaggagaaaggggggacatatttcaagagtttcaatacctattagaggaataacagcgattattaatcaggtggctgcaaagctctgtacaagatcatttttggtccatcaagttgtctctcatggcttcgtatgaacatggtacaggtgatagggtttgggggtggattcctgatggaaaggggaaccccggctcaaggctgaaaaatggacaggcagcctgatgggaaggctgactgatcaaacagttccactgagccccaggctggggagtctcctagttatgatgcatactctgtgctgtacttctgcttgaatttgaatgacagccttgggcaagcttccaaatctgtttcctcaccaataaaatgagggtcataatagcacttcccttatagaattgttagaagacgtaaatgagataaagcctctaaagcccttaacccagtgtcaaacaccaaataaatgctcagcagcaaacagagtgatcctatgccctgtgtatgtccagtgctattgtggtttatgcctattgtggcatactttttcactgtcagagcatcatgggttaggcaataaattatatggtcgtccaactgtcaaatgctatttattatattatatttgactgtaaaatatcatccattttcaatgtaagaaacccaaagattggtgagaggatgaagctagaacaactgtggttagctggatgctggccaggtcagagaaagtttctgtgaacagtcgttacgagcggcaaagatggtcagtaaatattctgtgttctgaagtgttctctctcttccttgcttctgaagtgaatctgaaggactccaatcagtggacataagaaacagtgacagaggctaaaggcagaagaggaaaagagtaatacatgtctacctgttctcttgcctccttgccaacaaagaacgaagtctgattaaggggaaagctaggggagttccctcaacttcctaaatgatgctcactccctgtctgcccctgttatttccctctcttttttattaaatctcatgtccacagtaaataatagtaaattttataatcctggttctcattttgttatctaaccagttaacctattgactttttgacttttagttcattctaaccttattcactcttgttttatctgtctgcctaggacaaaagtgatcattttccatgaagtgtaactacttttaagaattagaccaccttgttcttcaaatatttggaggacctcttactaagaccctagcaaggggaactctctgctcctgagggctctgctgtattgctgaataatccactgggccatcctagaatatactctattctaggagatgattccaaagtgaagctgtggtgctgcccctctcataacccctacaccctcagcactgctgcccctgcccacattgctcttccctgcctaggaatgggattcaagatgtatcctcacactcccttggcagtagcctgaatccagcataggatacttcattgagaaagctgggcaaccccttgtcccagaactgatcgagtggtgccattctgctcaaaaaatgaaggggatgccaggccacaaggggcagaggctcaagaagtctttttttttttcagcctacacagtggttcagaattcagaccacatgagctcaaagcccgactctactacttgctatttgtaagacatttagaagggtatttaaattctctatgccttcactttctcatctataaattgatgataataatcacatttactgatttttttaaaagattataggtgacaatgtatgtaaagtactcaggacagcacataatgttcaaaatattactatcaccgtcatgatttttaagttggagttagacttctttggagtataatccacatacctttaatggtttcattacatgactgatgtgttatatgtatattatatgtatatatgtaattgtgaatatagataccgcaaatatgtgtaattttttagtcatttagctaggtcctattctgccccagattttgagcaagtcattgaattttgttttttctttccctgtctttgcttattaatatatatgtacaacccttagaacaactctatgatacagaaattatcattctctttttttttttaataagtggcggaaggatgtttaggggagctaagtaacttgtccaaggttacatagccgatacatagcaagatttcaactgaggtagtctctctccagagattgtactattaataagaccatcagattcttcagaagaggtttcaactatatactaatatggataaaagaatagtaatttcttacatccttacaaacagctttccttttttcacttttttctttcttaaatttaaaatactttgattatgaatgtcaggactgacattgttgggtttatgttagacatctgaatgtaagagagcaagagtcaatgacttgctcaggtcctggaatatgggccttccctacaatcatagaccacagagatggactcttatttggagctcaatacatgtttgtggaatacatgaatgaattgtaagtcttgcatatttttcatcttttgatcagacattaccatatccatttgagaagtgaagaaattgagtcttacagaaggccagggtcttgctcacagtcataaaactaattaataaaagaaacaggattagactccaatcccacttgcttccaatcctgcactgataccctcttatcgtcttggtcctgctacgtacaaaccagagcacagacaaacctgggaaggaaatcgttctcagaactgcaattccatccagattgctcctctctttggaggctgcttcccccctcctttataagtttttcttttctggatgactgtccacactccatagcaggcaagccgatgctccccagtaatgtcagctgaggtctggtgcctccattatgtttgattaggcaagtttcttgttctgtgacaatctgcagagaacacacataataaatcagaagtctatggaaagtttaggaatgaaagacatctcttgcagacctgaggagctgagagctcatttttgagaccctgcaggaaacaaaacaaaacaaaacaaagctgcggccttaaaaaacacatttcctttgctttcagaggaacttgtctgtaccatttttttgccacttaatatattctcctttttactggctgagttccaaaagggtggacctccattcaggacccaggctgaggaaatagaaaaaaaaatacaagaagctgggatacaaggaagctaactaagctggacagtcagtgtaggatatcaactgtgtgaatttcagcatcacatgcctaggttcaaatcccaatttctccaccagccagtatatgggaagcttcactgtagaagtttagtttcatgtatcttattaccaactggtaaaatcctaggtcttgaggtcctgtggtggttgaaaaggcaggatgaagagatgggtacatggtatcacaaaactaacattcatgctgtacttttcttattctgagcacttgctcagcacctatgaagtattagattacagtattttattctttccatttaccagattcttaggagtcctccaaagggcccagggttcctagacccagggttcttctttactctttgccatgatacttattttgcaataatcctgtcctaactgcctaagttgaatatcctggacttaaggtttagcaacaaaaggaaagttgatttctgatggaacacaagaacattttagaaaggagaaatcttttctcctaaaggaaaccgtgaatgaaactgaaagaaacttcacctttgctaattataatcttgatatgcccaggctttactagcatgtgatgagagatgttatcacataaatattacacctggattttgctagcttgaagcctgaacgtaatgatcgcttacaaagtgccccaggatatttaagtcctcacagtctctacacctgccacagaagggtctatgtggacaagtaaaattgtgctacagccagcactgagtttgtctttggcaggttcaggtggcatccctgagtatagattctcactaattactctagtcactggccctaatttttcatagtgcagaggcagtcgggggttattcaaaaagagggaggttgcaacctctaggttatgctcggtcatgcatagttgcttagtattttagagtttactgaaatcattcttctaaattacacacacttagccaattttttgcccgagcacacaaacaccatccaggtgatggtattgggctggattcaagttctgtattacctggaacactactggcctcaagccactgctagattattgagtctgcctcaatatatcacagttttttttcttcatgatggcttttggggggcttttagtagactctggaataaattggcttctagtacatcctctcattcctgtaggttttcagtgcacagatgggatctgagagggaaacagttgtgaagcagccccaagggatggtgctcccaatggctgcagcattatataactggaatgacacagggcacaacttacacatacttagtgcccctttccctaattatttctgtcagacaatgttatggactgaattgaagcccctcagaatgcatatgttgatgccccaactctcagtatctcaaagtgtgattgtctttagagacagggtctttaaatatgtgtttgagttaaaatgaggccgttaagatggagtcctaattcaatgtgactggtgtccttgtaagaagagagtgaaacagcaggggcacatgtgcacagaaatgcctttgtgagaacaatgcagtgagaagcctgccatttacaaaccaaggccacaggcctgaaacagatcctgccattacggcactcagaaaaaaacaattctactagcatgttgattttggacctccaacctccagcagtgtagggaaataaatttctttttgtttacaccactcagtttttgctaatgtcaagcttggagaatgattacaggccactttaatccacctccaataaataaaccaagcatgaacagattttgcaaatgtagcttccaaactaatacattacatctcaggtccaatcagattgctgcctaaccccagacccacctgccataatactctcctataagagactttcactatctttttaattacctccagaaatagctacccagatcatgcctagttactagaggcatattgcatggctctgaacaaaagctatattcctcctccaacttgggacactctatctcttccctatggggtcattcttgtatcctaagctagtgccttttattaggcatccaaggtctatgcagttcctctactgtagtgatactacacataccactagttgtgatatgtgttcaggctcccaaaccagacaaatgtaaccctgatatttactagttgcataatcttagggttgtcatttatcttttcaaaacttaagttttctcatctgcaaagggcatgatagttgtcttagtcagtttgagctgagtaccatagattgagtggcttaataacaacataaatttatttctcacagttctgaaggctgggaagtctgagcagagcatcagcatggtctgttctagtgagagtcctcttccaggttgcagacacagtcttattgctgtgtcctccttggtggaagagaggtagctagttctcaacctcttataaggacactaatcccatttatgagagttccaccctcatgacctaattacccccttgaaagccccacctcctaatattatcacattgggattagggtttcaacatatgaatttgggggacacaaacattcattccactgcaatagtagacactttgttgggctcttacaaaatcattcatataaaattcttggtttagtgcatggctcatggtaatcattcaacaattgctcaggtgggaggttgatcatattattgttagtgttggaacctgctgttctcatcttctaacattatctgattcactttcattgacggcctcagcattctttcagtatataaaataatttctctgttgtggggtattttctcaccagtctttattttgttattagtcgccatagaggtaaaatcgatgttttccacaacactctaaatttatagggctgggagagccactttccattcccctcagaagacacaggatgaggcagagtaggcgtgggagaaacctatttttctcttggcaattgcctctaggacacattctttatttaagaataagaacctttaacaataaccctgagtcacaagtatcacacacggcagacactacatttacaaaaacacctcagtgaaggctgtataaaaacctaaagtttgtgcatctcatatgatcttttttatcagtttcatggctgacacacgagttttctctgaagaggtgtacgcttttcacagtcactcagtatttttaaaaaaggaaattaaagcatttaaagaacatgaactatatgctgtgctatgtgccattgatttctcacagcagacttttaagttattttgtttccacgctacatatgagaaaaattgagactctgaagagctaaacaacttaaccaaggtcatagactggtttatttaattttaaataatctattctggaatttttatgaacaccatgaaatttaccctatattaaacagtgattaggtagagggaaaagagggagttttcttggtctacaaagagaatattatcatttaaaaatatatatcaacaccattgaaaaacaaaaattatctctaatcctaccacctagagatcatcacttcccacattttcatcaattaaacaataattgtgatttgtataggaaactttcaatcgttcatatcaatgcaagggagagaaaagggtggagaatctaaaaatcatttctgtctgcattgcgtgcttttgggagtagaaaattaacctttttgatcatgttctgcgtgggctaatgactaaaattgcttttcctttcccaactgatcccaattcagggcagagtctcagaagcattttgctgacaagggattaaaacgtgctgcggctaattcaagaagtggaaactcctcacatggataattaagatctgactgcagaacaaaagcttgaacgttgttgtagactgggggctctccagcgtttcaaacactttatccgcagagccatcttgaaaggtagattccattcaatttgcctggcattcattgtgagactgacttactctgcagtgtgttaaatgtccaggaaacagtgtctgattataagggacaggcaatctagtgaaggaggctggtatgcataccactaactttaataatagtaacagtgatcattttagctaacatttattaagcaattactttccctaggtccagctctattctaagctccttaaatgtattaactcatttaatcctcatataaaggatagtggaaccagtggaaaacactattcatttagagaagaaatggtttatcctgaagtaggagcttagaagggcttcaagtactattgtcatagctagaagctcatatcctgactggaccatatttccaaatctgatattagcgatctctcgatagctgaggcacgtacacaggtggttcgggcaggagtccttctgctacatctgtttattccttttcctctcattaacagtgaccgcctggttcacaataagtccctctcctctaggaacagtctccccaacacatacagtggactccacttgccatgcctctgtgaccacatatggcactgcctctctggacatagctgattagaccaggcattggcaccaaatgaagctgggccatttagatactaatactggattatttccactaaaagtaaggggaaaacatcagtctttctctggtagtaggaactgaggaatgtggatgtttgagagctgttggtaactgtggtagccatgagaataggccactcagatctctgcttaggggagtgtaatgaacctgacctagagccccagtgctgactatgtgtccactgtctgttcacatggaggccacactgctctcagcctgtgactgggcgcagcatgagagggaagacagactatctgtgagacaggcaactttggctccaggactccccacaagcacagctgaaactttcttagaatagcatgcagcccaaactctacccatccaacattccttccttcctcctccccttcacaggggtcaggtgtgctcacagtgtggtacctctcactgtctcttctggttccctccccttattccctccttccccaacaaaagccatgcacatctgatcccatcttggcatctgcttctttgaagaagtgaattaatgtcaggactttctctttgtgtgatctttgatccttgggtactagacagtttcttcataaggtaatggtaatgttcgaagtatcacatttgcggatgtcaaattagccacccagccaagaccagagtctatggtggaggggattacacaaggttgtggatactcaaaagtgattcactggccatcatcagtataaacatctactgcagctactaccaagaaagttacctgcatttcccaaaaactgtaatttatagagaggtaattttatgtcctgtcttctggagaaaaaccacatgcaaatagatacacggaaatgacaaagattgttctggaaattatcataagtagaagtaatttttagaaaagaaactgtatttgtatctaagtggctcattgaaatatctctctggaggtagggctggtatttctaagtcttctttaatctttgggaacaaaatagagaaaggaggacaaactgaagctttggtaatgctgagttaattggtgtttttttcaatatgaaccatgctctgtgggcaatccttcattcagcaaatcacctgtgaggctatcccacaaaaagacagtggacagaagtgtagctaagttctactgttagtggaagtaaaggtgggaggaatagggagggccttgtgttgctgttcggtaggaaattgagcacatttaaaaaagtgttccttttttgggacctttcctatgaattacatagtcttggtctcacagtacttcttcatcttttaaaactggtcttagcattcattatgttgcttgaggaattgaaagtaagccactatttagagcaattgcaatagatccctttttctaaaaccactatccttctaatcgggggatgttacataaaaataggtggactgtgcagtaagaaaatttagtgatgagtctggattttcttacctgtcctcttgaactccattttaacaatgtgggatctccagttgaattatgtactatggccatcagtaacattgaggggatcatacagagtgttctgtagattgtgaagtactcgtttgtatatttttaatttttttattgaggcccaaagcaaatgaaaagagagaggttcattgatcctgtgctgggtaagagaaaaatgacaattcctccactctgaggtcttttgaagaaagttgagaaacagtgttgtatcttgaagcatttcaatgactcatactcttccatccaaagttcagaaatttatggacaacgcactgagtccatattctagattatcagaacaaagggagcaggttagacaagtaattacttctttcctcatttacactgcttcacatgtacttagcccccagggtccatttcctgaagttcacactatcagaaatgttctgtgttaacaccttaagtaggcacaatacaacctcacttggcgttagtattgattctagcctccaggtactttatcttgggggagaaaagtgtttcaatatttacctgtgttatgtaaccacacatatctgagaaagttagaattaatttctgtctgtgctgcatcagcacagaaagtaaattaaataaagacttttttattgaaaagaaagagtcagtttcttttctataaactgagttgattacctcaaggtttcataggtgtgggcaagttgggggcaactcaaaaactcaagctcgtctcctgggcagtcacaaagtttacaccagccataaaaatcccaaggcatttgtgtttaatgttaatgaggaagtggatcaggtgaatctacaaatctcaacaggtgacaaattacaaattaggctgagctgcttttggccccctggtgaaggagaacagggttgctgggagaaggtgctagctgatcctcacgtttgcttacaataatgtgataatgaagttcaacccaagaaaatcagatggagcagccctctgggaaggctgcctccttcttctttgctacattgtctttctaagaatgtcagctacaacttctcacaccctatatttcagaggccttcacaatctgttcccaacttgcatgaagccttttgcctttttattgcctatagggtaatgtgacttccagtagttatggtatctaaagcccttctcagatggttcccaaccctcttttcgcatcttctctctgacgactttacttgctccttctcttcagataggcaagcgactggactccgtagtattccacccatgccattattcttgcaatttcctctacccagaatattatcttgctgtttctctacctcatccaccaatgaattcatcattgtacagtgaagtcctcacttaacataggttcgtagaaacttggactttaagcaaaacaacataccgtaagttcttgaataatatcatttcattcaaggttgtttcattataaggttgatttttaaaaattggttttcttatattttgtttagcttaaagtcgcaatttccaagaacctattgatgatgttgagaacttattgtattcttcaagatacagcataatttcgactcaaattttctttctttcaccttccaacagatggaattaatacctcctcctcctactaatgccattctagcattttgcatagacctacccattataaagacttagacttataatcaaataaatttattcaacgtgatggtttttttttttaacctaaatcagaagttccttcaggactgggtccaaatccctttcagatacacaatgccaatttcagattgtctccccactcccaaacatgacattagggtgatagcttaaagatgtggaaccagtggcaggacctgaaagtcgtatcctaaattatccccaaggtaaaataagatgaaatttatttcatcttgaggttaaattttatatgtaaatttggctaggctatggtacccaattgtttggtcaaacactagcctagatattgctatagaggtattttatggtgatgatgaacatctacaatcagtgactttgagtaaaagagattaccttcgataatgtgggtgcaactcatccaaaagtgaaagcttgaagagcaaaaattgagatttactggagaagaaaaaattctactttcagacagtaacatagaattctcagtttccagcttgctgggctgctctacaaatttcacactcaagacttcaaaatcagttcctgcttgagtttccagcctccctctttgctctacagattgcagaattttcagcccctataatcacgtgagccaattccttaaagtaaatctctttatgtaaacacacacacacacacacacacacacacacacacacacacacacacaccttcttggctctatttctctgaaactctgactgaatatacaaaccaactagttagagtagaagctgaggtatgcagccaaagtgggcacgagaaactggaaagttaaggaataaagaatagcagagaaagtgataggcagaaatatataatgtccagaggtgaagtgcaaatgctcgtcaaggctttttatggctctgaggcttgtgcaagtcaatttggcaattcttatgacatagtacatatccattaaatgttgctgaataaactaaagaatgcatttatgaatgaattcatcaatactggccttctcttctcttcacaaaaacttgatagttggaaataacaagagtcaggatgtctaggacaattctgactcctggacaaagtaatcaccaatcaggctaagtgctctttatccctttcacagccacaagttgaacagtgaaataacaagcctacaccaaggtaaagtaataatgttttcctatttaaagttttaccatgttaagtgagatagctttctcagcataagggtgacgcagacaagcagaaaatggctgcctgctagtgccggcttctttagtttggctgttgaaatcatcatagaagctatcaagggctgggggcactcctttgctacacacatcatctttccagtaacatctgctcactgggccaaggatcaattatctctatagaggagatattgctgccagtcctcaaggcaaaaccctgcatgtgaggccagtcttggacaacatcccagaagcttgattttaccctctggacatcatttaatctcagtcaaagggttttgctctttgtccccaggtatatgcagaatgcacacctcagaggaagtgacagaacagattgtggcttttaaaagagtttgggtactgccatgaatggcaaggttctcttgactactatgtagctgtcatcagggtaggtatagcagtccagtctctcctctattgaggactgtattttgttgccaactagtagctcccactttatcttctattctttcattcaacaaacatttattgagcacctactgtgtgcaaggtgttactgagagaaaggaggctacagggaggaattatatgtaaaacttctactgctggcagaaacaccaagttattacattgcacagataatgtggcaagaaaaaagatatagattaatccataagaatttagggggacaaaaaaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaaaattagccgggcgcggtggcgggcgcctgtagtcccagctactcgggaggctgaggcaggagaatggcgtgaacccgggaagcggagcttgcagtgagccgagattgcgccactgcagtccgcagtcccgcctgggcgacagagcgagactccgtctcaaaaaaaaaaaaaaaaaaaaaaaaaaaaaaaggccaaataacttcaaatagggcagtttaacccaaacctctataagcatagaatcattttacagaggagcagtatgcacagataagatttcaagaggcattctttgggaaatgctgcaatcaagcttttggatgtattctttcccttgagagttttatatttatcaattatttcccaagctatatgccttggagcactagacttctacaagatattaatcacagttctatatggattctcaggtcaaataaatttgggattaagaaaagctgcatatttactccctcctctgccctttccaatagatttttaatcagtttttggtgtctcagcatttttcaggatgttgagagataacctattaacacgttaaaaattttaagatatccagcagaaaagaattctgattaggaaatatttaaatggagactcagcttggctttatggtggcatctaagatgagccttaaggggacagaaaggattgttgttgagaacaggcctttttatttgggcagagtatgttgtccttgctgtcatattctatggccacaggcctcttttgaaaactggcattgtctctgtatctttccttgtcatttcttcgggtgaagagcctgaggagaggcaccccatttccccctccacctcagcactgctgtgcagttccgagatttctctaaaatgactcccaggttctgggagttaatgcctgagagtttgaaatgcttcctttgtcactgccagttatatctccaagcagtaacttctcaggattgcttagtaagagttccacctgagctgaggaatggtgtgttttctattgatagagtttttaaatggggaaattcattcaagtggagctttttatggctttgctaggttaattgggaaattggtgacattgctactagtgttcttgaggatgaaacgacaaagaggaagattgcaagcaatctgagaggttgaagtcagctacatgagaaagcaagaaagagatgaggtcatctagttcaactattggagtgcagatcttaagatgtctattctgttggaaaacatagatacaggggggaaaggaagataatcgagaaggagagaaaggaaaggagattaaaaatttgactttctcatatgcttacccactccaggaatgggcaatctttactgcctcagtctgagaggtctctcttctctctagcctgtccttttgcagatctttattctctcatccccacatacacacagccctcatttatattctagcttttacccaaacttctagaaaattccctgttttttttttttttaagtcacccttttgttatctaactcagctctctaactttaaacagaaggtctgatccttgcatcgtaaggccaggatacaaacaaacaaaaacagcatttggccaatccctatttctttaatggtaaaaaatattaatttattttagggtttctttaagactattcaataataactcagttatttccagcttatgatttagttcgaatcagtccttccaaacccagttcctcctcagagtgtcctcatccagattctcatccagattcctaaaagcctttggcagcagcccagaaatgatgccagagagggattggtccacttcccggaggtcactgatgcaacatggtttttgccccttggaatgcccagtgcttgctccagaaggtagtgactggttgtcgttgttccttcggtactcccttaactccttgatattggtaatctttggtaaactgcagatatgtcctccttcagtccccagattggcagtctactcatatgttctgatgtagagtccttcctggcccagccaaggtaatccccaagaaggccctcaggctctctctcaacaaaagccttttctcatggtggtcttagcctcctctgatgccaagatatgcctgtcaccatctctgttgatctctgtcatcaccaaggcatatttgccaacttcaactctttaaaaaaacacacacacaaaagttccaacatttcataagggaagcagggcaccaatctgtttactctagaggcactcacatttcttggttattatctaccattcttctcaatttattttacttgtatgaaaaatgagcaagactcattcctgtacagcttcttcctctatgagctcctctgggtcagaaataaagtgatattttcttgttagcatctctggaaaaaatcacttttgacccgtactatgttggttctttttgaatttatatgcttagaatgtggcatttccgtgggggttgtctatactgcacatgcccctttgtttatatactatgtgaccaggggtctgcagctatgatgagtcagaccaaattaccctgccaatgcatactttgaaatagtattttgcctcatgtgtataactataaattgatacagttatatagtgtccctgcccaaatctcatgtcaaattgtaatccccattgttggaggtggagcctagtgggatcatgggagcagattcccccacttgatgctgttctcatgatagagttcttccaagatctggttgtttaaaagtgtgtggcaccttcttactctctctccctcttcctcttatcctggccatgtaagacatgcctacttccccttcaccttccaccatgtttgaaagttttctgaggtctccccagaagccatcatgcttcttgtacagccttcagaaccatgaatgaattaaacctcttctctttataaattacccagtctcaagtatttctttgtagcagtatgaaaacagactaacacagaaaaatggcactaggagtcgatcattgctataaagagacctgaaaatctgaaagcaactttggaacttagtaatgggcagaagttggaacagtttggagggctcagactttcatggggcctgtagccccttgcttttggccaatttcccccttctggaaaggagcatttactcaatgcctatactcccattgcatcttggaagtaactaacttgtttttgattttacagacttaaaggcagaagggactagcgtgatcacagatgagacttgggacttgggacttttgagttaatgctggaatgagttatgattttgggagactgctgggaaggtgtgattgcattttgaaatgtgagaaggacatgagatttgggaggggccggggcagaatgatatcgtttggaattgtgtccttgcccaaatcgcatgtctaactgcaatctcagtgttggaggtggggcctggtaggaggtgatgggatcatgggagcagattaccccatttggtgctgttctcatcataaagttcttacgagatccagttgtttaaaagtgtgtggcacctccctactctctccttcttcctcctgctctagccatgtaagacatgcctgcttccccttcaccttccaccatgattgaaagttttctgaggcctccgcagaagccattatgcttcctgtacagcctgtggaaccaagagccaattaaaccttttttctttataaattacccaatctcaagtatttctttatagcagccagagaacagactaatacaatagtctgagaacagactaatacaataactcagagatcctaattttgccaaccttcaggagctactctcctttaaattaaataattgaggaccaagacaggtggctatagactttatcatgtgattatgcctatgcatttatgagaacttcccagggaatattttcaattgtcacaaatattttttatttccatagacagcatcttactctggactgctactgttttttgaaatttccttctgctatctaccccaattgttgaaacaaagttgaaacagttcccttgctatttccccaaaatatatctaagaccagcttataatattaacaatacagaaggtaattacaaagaagaaaagaacattttaaactgaacactatagatcattgtaccccaaatcctcaagccatgctcctccacaccatcattctatagacgatgtgtcaccccagtctctaccatacaatatatttcaaaagctactctattctgcaagctgagctagaaatgtataatggctcaaatgtgatggacttttatttaccactcacataaagttcaaggtggatttttatacttggaaagtagatcttcatgcagcaattcagggatccagactctgccatcttcaaaagattgtttccaaggagactgtgctcatctgcatcaagccataggataatgaaggagcacagagggtcatatttgggagatctttatgaattgggcctggaacattactctttttcatcttccactggctagaattcagtcacatgaccatacctagttgcaagggaatttgggaaatgtagcttaagtgcacgcccaggaacaagagaaaatagacttggtggacctagcttaaccagtttcaaagggaaaaaccagttgatctcttctccattaagctgtcgctatcagataacacaataaatcaaagataataaatctccttacaaagaaagcgatccttttacaggattatatttatcatccattatggaataggaactttatatttggtcacctgagagccaaacagaatacctctttaaaaaacatctgccctaaaggtacattttgcttttgtctctagaataataaaaatatgtcagtttttagaaatagtgatatccaattttaggtaacgccatcataagtatatctatatgtataaataagcctaactttttactacttataattagaaggaagtaacttctgttttcttctgtggatgaaagaagcttttcattccctttataaataagtcttttagaactacaagcttattcttctgaaactgggatgcaggaataaagcagagacaagggtcataatgctctttgactagggagtaacttcaaggcatttatgtgtgcatagaacataaagttagcacaatcatttataacaaaatcatcacagaactgatgtgtacattacaacttagatgactaaattcaatttgctacaacaaacatattctaacaaatacaatttcttataaaaacatacagagagtcaatacaatatccaataacaaatatataaaacgtttttgcagtaattgtagcctcaaggttaaggattctattctataggaaataacaataaaacattatacttaaagaggagaatgttaagaagtctggtcatttttggcaaataaactgcctataaactcaatgtcacattgtccagatatagattatgtttagatgtacctttatcaggatattccctcagccagtgctttgcattctcaaaggtacttgtgtcatccatcttcttattctctaaagatttctcactaactgcaattacgatttctggtcaatgatatcaatacaaatggttttttataattgctgaatacaaaattaggggcttataattttctattttcatactttctttttagaaaatatcccaaaggtgtagctacttcaattattgagcaacatgctagaaacttgtcaaaaagccaaagttaggctatttattgccttcacctatccttatgtgtactctacaaatgtgttaaccctgctcagagtgtatgcgcagggttcatgtatgtgtgagtgaaaatgtgtgcatgtcttggctagtaaactagttaggactcttcattgcaagctatagaaattaactttgggtaacttaagcagaaaaataatttgtggggacatgtcatttggctctcagacagatgaaaagcctggggaacccaacttaccaaagaggccgagattaagggaggcaggttcctgggcctataaccaagatcataaagtaagaaaagtgtggttagggcaccagagccactactgctgtttgccactacttctatttttgctcctgtgacactgggcattgatcatgttggatgtacacagcagaaaatctatatcctgcttgacttagttaaggttatctaaccacaggcaagcttccagggtccaggaagagcccgtgtctaggctttttgactcctggcctttggaaggcaagtacctatctgccaaacctaagaggctcaatggtgggttaactaaaagcaaagacagcaaatggtcactataatgcattgtaatgtggagtccgactcaatttttgatgcctgactactgacagctttgaagcttcatcccttcattgtccctttgtgccctacatttggacaagcagataagaaagcctgggtgctcctgcctttgattcaaaccatgaagcccctgccatgaaaaactctcacctcagcgctaccttctaactataataaaaacccaggcagtcacttttccttgctcacttaagccatctcagacctgcttgagagtaatgccgtgctctcccacagacctcaattatgtaagtaataaaccttttaatactctcttggggtgtgtgtggtatcatcagtcacaacatctgaacaaaacctgggtgaaggtccttctgcctctacagatgaccataacatggattcaaaatatggtatattagagtgacttcctaaaattctgatgaatttttcacaggattcctttaaataataagcatccttaatgcattcaaaacatgatctacaattccaacagactttccagaacttaattctctgcatgatggaagtaaaggcaactccaaggtcaacaagccacatcccctcctcagccttttctgtctttcctctcctatttcctccttctcctacccctgctagatactgggattacaaagaaaagctccttgctcctgctcaatgtcccagtcacttactttagtttacccttcatgatcccttcctactccttccatcctgctctataactccctcttctccccaccccggcaccacccactgtacccaaccaccttccttaccagggagaagacaagaagggtttaatgccagaatcaaactatgtacaatgaacctctgaggaggaagacaggggtgattgctgggctgagcctgctgtttccttgccattctttctccaggtcctcagatgccatatcatcgtgggtgtgctgccgggtgggcatcccacctccagcccacagtgttcagtttcactttttagtgagctgtaatatctatttttcttgctttcttttcctatttattttgtaaaaatgtactgagttttattaaaatatacacccataagaaataaagagataagaaaaagagaaaaagaaacagaaagagagagaaatacagaaaagaaagaaaatattccaagtttttgagtgtgagaggagcctaagtgcccagctttgcctgatggatagatgagagagttttgaagctatctgaggcttattttcctgaatgaataggaatgagctcttcgtgtgaattgtaatttaacttatactctgaatgaaatgatttagagcatgtgaagatggaaggggccttaagtgaacatctagtccacccattcttaccccaactccccttgtaacagccttggccaatctagcattcttgatgaagtaaccaaccaacttctactggtacatctccagtgaaggttagttcttctttggatgcatctggcttataggaaatccttccatttttgcttcacttgagctcccaattctttttgggtcacccagaacagcccaatatatctttttatattcagaagccctgctttgaattatccagtatcttgtctgctcacctatgccctcccctttgcccagaaatatcaactgaagactgtaaagacacgtctgcatccatcctgcccactgactaaaagcatcaaacgaatacatagatgaccaaatatttcttccccgtgatgagctgtccatgtgtgctctttagccataatgattgtgataagggaaagccctttctgtgccattaagaactgatcatgtgatttatgctccagctccaataagcatgttgagtatattatgtgctgcctttactggcaaggaaagccagtttacttgcttcttctatagtaataaagcctcctttcttactctctgctgaaaaaagcgtctgaatgtgctttgggttctaaagcaccctatttatagccccattgtcaaatgatgtctattcattacaatgctggatttgcaggttatcattctgtgtctgtgaaggcaggcacagatgtatgcatggggcattcctggctgacacaggaaagggaagtcttaaggctgtctagtttctgggtatcttctgaggataggttggaaaatatcgtatgagtttaaataaaagtccttcttagtccataaagaatggagctgacattgaatcgacacacagaaaccaggtaggctgtgggtccacccagaggagtttttacaggtcaaagcctccttgttttattacagactctcatcttaacattagaacttgatatttatcacaggtgcacttctaaataaagtgttttaagaacaatccatgatttgttatttccttgattttatttgatttctctaaggagacattattctggaagcttgtagaaaatacattttgcaggaatctttcattttgtacaccttccagtgatctggtaagagaaaggaagaacttgagagaaaaggcctaacaagtatttatttggtgttggaatctattcttgaagaccaagagaggtaaaaagcaaagaagacaatttataacgtatcatctagatgcaaactggaaaatgcatggtggtacgctggcctgttggagataggagaattagatattgagaacctggtgacgaagtgagggtggactgagaggagacagagaggtgacatctatactggggcttgatgcttctggctatgaggattgatgacttgttcctgccttcaaacctttgtccttacttcctccactagaattccctcttcctagatttttgtctgttgaaatgctctcctttctttgtggttcatagtaatctggaatagaggtcatttgtgcacaagagaaacattttccttgagagattcaaatcctgaagttggatatttagtatgtcaaaagaaccgttctcacctcactctatgtattcccaataccatatcatattctgattgcatctctcttaaggttcttgtcatattcagctgtgtattagttatttctctcttattacgaagttattttaaggcaagtactgtatctaactcatcttttcatcctcagccaagcaaaaatgtctggtatatgggacccacccaattggtatcaattgtcagacttactgggctttttgagacacatctctgggtgctttttacagaagataatctgagtatttgaatgtggcaatgtttgcccttttgacaggctttgaaaggttaagacaattgctcaagtatgtagttattaagttgaggagccgagatatacatcctgattgctctactctaaatcccatgtcccctagacagaactatcttttgaaggttaaacagtttcatagagttccacctggccttgtttaacttaactttgaattttgttcctgtttggtgaactgagcccaacgtgtttcagatgggtgttgtctcaacttattaacgacaaaggtatatattttaatgataaaactttttatgttcccatttgaaactttgagctatcatagtcctagaatctagatatcaatgatctctttgagtccttctgatctttttcacatgagaaaatgaggctgagaaattatgtgaccttcccagattacaaagcgagtggcagaactgagattagatcctagacctctgggtttatattttgtagatcttaccatttcagcaaactaggtcccccattactgtgcagtcttcactgccacctttagtgaatgtccttcagcaagttatatgatctttttgtgccagagttctaattagtgcaccaagaaggttgcagtggtccacttctcagggatattgtgaggacaataattaatagctataaaacattctgcaatatgcagcagtatacaaacaccaacatggcacaaccaaatctatttcacagtaattaactttatatccaataaggaagaaatcagtagagcaattcctacatgacttggcagaaatgcctattgtctctgtatcttaagaaagtggccgacagccagaaaagagaatcaaactgtgcttgcgaatttatcacaagatgttttgtagatgaatattgtttttcttcttaaatattgttttttaaagcatgtgccttttcaatgggaaggaagtgctgatatttatcaaccatgagcataaatcctccatgaatagtaactattatgcatatcgcataaatttaagttattccttggtatgcacagggaattggttttaggaccctgcagatatcaaaatgtgtgagttctcaagtcccttatataaaatggtatagtatttgcatataagctatgcaaatacctcctatatactttaaataatccctgtattacttataatacctaatactatatcaatgttatataaatttttgttgtactgtattatttttctatttgctttatttttaatgttatttttattttttgaaaaaatacttttgatctgcagtttgttgaattctcaaacacggaagctgtggatatgaagggccaactgcatttttattataaaataaacgcacagcaaaggttattttatccccattttatagatgaaagaatcacggctcagattaagtaactttattagcatcaattcagctaataaatgctgaaggcaggatttcaacctgtatctactatattccaaggattttttctccaaatttttaactgttgtaaatacatataacatacaatttaccatcttaaccatttttaagtgttcacttcagtgatattaagtacactcataatgttatgccaccattaccaatatccatatccagaactctcttcatcttgtaaaactgaaacgctatgctattaaacaaaaacttccctttcccctgtcttccataccatcaatccctattctactttctgtttctatggtattaactaatctaaggacctaatataggtggaatcacagtatttgcctttttgttactggattagctcagttagaaaaatatcttcaagaatcatccatattgtagtgcatgtcagaatttcatttcttttttaggctgactgataacctattgtatctatataccacattttgcttacctattcattcactggatgaataggtggacatttgggttgtactatagtttgggtgtttgtcgtcccaaacctcaggttgaaatctgatcccctgtgttggagatggggcccactgggacgtgttctgttcattggtgcagatcccctaaaaatagattaatgctctccactgtaagcaggtgagtgagttctctgttggctcctgggataactggttgttgaaaagagcctggcacctccttcatctccctcttgcttcctctcttgccatggcatctctgcacttactggctacccttcaccttctgccatgagtagaagcaacctgaggcctttaccagacacagatgctggcaccatgctttttgtacagccagctaaatcgtgagccaaataaacctattttctttgtaaattacttagcctcaggtattcctttattacaccacaaaacagactaagacaggttgcttctacacttcagctgttgtgagtaatgcttgtatgaaattgggtatacatatgcttttcaaggtcctgcttttagttcttctgggtatatacccagaagtgaaactgctagattgtatagtaattctattttttaattttttgaggaacttttatcctcttttccaaagcaggagtaccactttattttcccactaatagtgcaaaagtttttaatttatctgcatccttgctaacacttcttattttctgttattttgatagttgtcatcttaatgggtgtgagatggtatcttgttgtagttttgactttcaccctaataattattaatgttgatcatcttttcaagggcttattggccatttttatacatgttatttggagaaatgtttaagtcctttgtacctttttgaatcagtttttttggtagttaagttttaaaaattctttatatattctagatattaattacttatcagtatataatttgtaaatttgttcttctactccatgggttgcctttttaactatgttgatattgtcctttgatggacactttttttattttaatgaagtccaaattgtccatctttgttgtttttgccaatgcgtttactgtcatatccaataaattattgccaaatctgttgtagacattttgccttgtttttctaagagttttataattttaggtcttatgtttaggtcttcaattaattttgagttaatttttgttcattgtgttacatcagagtccaatttttttcttttgtatgtagatatccagttttcccagcaccatttgttgaagactattctttccccactgaatggtcttggcacctttgtaaaaaatcattagaccatatatgtgagggtttatttctgggctctttgttctgttctattgtcatatatgttttttatgccagtactatattgttttgatgattgtagctttgtagtatattttcaaatgaggaaggatgagttctctagctatgctctttttctcttttgtcttcaagtttgctattttttccaagattgtttttgtcgttctgagtcccttgagattccatataaatgttaagatgagtttttctagttctgcaaaaacattattggaaatttaataaagattggattaaatctatagactgctttgagtagttttgatatcttaacaatacagccttccagtctgtaaacatggaatgtatttatttcttgaatttctttcagtaatgttttcttttggttttttgtttgtttgtttgtttgttttgagatggagtctcactgtggcaccaggctggagtgcagtggtgcaatctcagctcactgcaatcttcacgccctgggttcaagtgattctcctgcctcagcctcccgagaagctgggattacaggcatgtgccaccacacccagctaatttttgtatttttagtagagatgggatttcaccatgttggccaggaagatctcaatctcttgaccttgtgatccacctgcctcagcctcccaaagtgccaagattacaggcatgagccaccatgcccggcctcagcaatgttttatagttttcattgtaccagtctttcacaaccttagttaattcctaaatattttatccttttcgatgctattgtaaatggctttatttctataatttccttttcacgttctttattattagcatataggaatgcaactgatttttttgtgttcgttttgtatcctgctattttgctgatttcatttcttagttcaaatattttgtgtttgtgtggaatcttcagggtttttctgcatataagagcatatcatctgcaaataaagataatattagtttttccttttgaagttggatgccttttatttatttttcttacctgtttgctctggctagaatttccaatgctttgccaaacagaagtaccaagaacaggcattctttcttaagctttaggtctttcaccattgaaaattatgttaattatggggttttcatatatggcttttattatgttgaagtggtttcttctattcctagtttgttgagtattttttatttgaaagaatgtcgaattttgttaaaagctgtttctgcatcaattgaacagatcatgtggctttttcctttcattttgttaatgtgaggtattacattcataaactttcatatgtcgaagtattcttgcattcaaagaatgaatgccactttgtcatggtatataatttttttaatacacttctgaattcagtttgctagcatttggttgagaatttttggattaatattgatagggaatattggtctgtagttttcttgtagtgtctttgtctgggtttggtatcagggtaatgttaatgtcatagaatcagaaagtgtcccctcatcaatttttttgaaaatatttgagaaggattaatgttcttcattcactcatgaagacaataggtctagggattttctttgttgggattttttttttcctactgattcaatctgcttacaagttacataggtctacaatgtagtctggttaggttttgtgtttccagaaatttgttcatttcatcccgggttattccatttattggcataaaattgttaatagttccagcagcgtgatctcagctcactgcaacctccgtctcccaggttcaagagattctcatgcctcagctgcctgggtcactgggattacaggcatgcaccaccatgcctggctaaatttttgtatttttagtagagatgggttttcaccatgttggccaggccagtctcaaactcctgacctcaagtgatccacctaccttggcctcccaaagtgctaggattacagacatgagccacatctcccagcctattttcctattttttatttcatttatctctgctctttattgtttctttccttctagcctttggttcagtttgctcttgttctagttcattttttaatgtgtttatagtcataaatttctcccttagcgctgctttccctgtgtcctataagttctagtatgttgtattttggttttcatgtatccctaagtattttctagtgtttttttcttgtgatttcttctcttatatattggtagcttaagagagtgttatttaattttcacaattttgtaaattttttcagttttatttcttttacttctgctgatttctaactttatcctattgtagttagagaaggtatcttgtacaatttatgtcatttaaaatttactgagacttaatttatggcctaacatatcatctatcctggaaaatagctaatgtatacttttgataaatgtgcgtgtggtatgtttggatagtgttatgtatatgtttgttagatctagttgatttactgtgtcaagtcttctattttcttaattatcctctctctggttgttctattcattattggattactgacatctccaactattaatgtagaattatctacttctctcttcaatttttttgttttactttatatattttgattgtctgttattaggtgcatatttataattgttatttgttgtatcttcttgctgtattgaaccatttattaatatgtgtttttgtttctcataccttttttgatttgaagtaattttgcgagaagttagcattgcctattctgctgtcttttggttaatatttatgtgaaatatcattttctgtccttttacttttaatccttttggctccttaaatctcaagtgagtcttacagacaacacataattggattatgttttttaagtccagtctgcaaatgtctgtcttttgattggagaatttagttcatttacattttaaataattactaataaatacttccttctgtcattttgttatttgttttctatatgtcttgcagcttttttgtccctcgttttctgcattactgtcttttgtgtttagttgattattttgtactgaaaggtttaaattcctttctcatttcattttgttaatattctatagctattttcttttacttaccatgaagattacatttaatatcctaaaattatagactctaatttaaacttatgacgtcttaacttgaataacatgtaaaaactttactcccttaagagctccatcctcactgctttcagttgttcgtgtcacaaaattgtatctttatacattgtgtgctccaaaacacaaactaataattattctaaatgcattagtctcttaaattatgtatgaaatattgttttacaaactaaagttacaataatgctagcttgcagagtaataattgtttttaaaatgtattagtctcttaaattatgcagaaaccaaaaagtggagttacaaactatttttgcaaataatacaagattttataattgcccatgtatctaactttaatgagatctttctacagcttcaagttacttttttagtgccctttcatttcacccttcatgacctctttggtatttcttgcaaggcaaatctaatggtaacaaactcctttagcttttttttacctgcgaatatcttaatttcttcctcacctttgaaggacagttttttccttggattttttgatttttgttttgttttgtttttcttttggcactttgaatatattggcccattgccttcagggcttcgcttcttttgagaaatctggataatcttattgagaaatctggatccttgtacgagacaagttgcttccctcttgttgttttcaggtttctttttttgtcttttgaaagcttgattataatgtgtcttgatgtggttctcttttttgtcttacttggaatttatttgatgtctatatttatgtatgttatgcaaattggtcacaaccatcctggacaacaacccaaaaccctgtccctaacaaaaacattaaaaaaatattagccaggtgtggtggtacatccttgtagtcccagcactttgggaggctgaggtgggaagatcacttgagtttgaggttacagtgaaatatgattgcacactgcactctagcatgggtgacagagcaagaccctacccctaaaataaataaagacataatttaaaataccaatgttgggaagttttcaaccattattttctcaagtacattctgtaccccaaatattccatctctctcttctctttctgaggcttccataatgttaatgtttctctgcttgatggagtaacataggtcccttagactctgttcactttttttcttttaattcctatactcaataatttccattgttctatcttcaattttgctgatttttttcttccacttgctcacatcatcctttgaactcctctagtgaatctttcatttcaattattgtacttcttagctccagaatttctttttttaggttgtcagtctctttattagtatttccattttgttcatacattgttttgttctgttttaccttctccacatcttctttagttatttgactatctttaagaaaattattttaaatattttgtctagtagatgcttgtatgccttgtacttttctttaactctggaaatcagattctccctcttctccagggcttgctgctttttgttattactttttatggtttttgtttcgattgtcgtatgttctcggtgccagtcatcagagtgaggtataaacttaaggtctttttggatattttctgatcctgtgctttttcctgggtatgtatggtcactttctaatttttcctgtatgtacagttgttttttaatgttttttaatatctgactcacaaaagggaaaaataagagtaaaaagagcactggccctctacatgtctttgagttcacttcagctggagagagagaggctcacaaacataggacaaacaacaacagccgctggcctgtttttctacacctctctaactaaatgcagcaattggtggtcagaacacagatgcctgctatttggagaatagggtattttttttgctcatcctgactcctacaagctgtgtgcaggttgctccaggaacacatgcacagctgccatggggctgagggtgggggataggtggctgctactgtgcaaagagctgaaatgggctaaaactaattacagtttactatccaagccttctctttgaagttgcaagccttcgatagactccagaatttcaaaatagttacatcatattctgtcagtgcaatttttttctagatagggaaattactagggcttcctattccaccaccttcccagaaccccttttaggatttttgttttttttccttctacatgatattttcatagtcaatagactttgtacttttagttaattttctctcaaatgatataaatctagcatttatccagccatactctcatgcttgtctgttagccaatagttcacagttttgaacttgctggataggttaggacaatctagaatcatgacacacacattttgtttgtttttttatgcagttcaaacccaatactttaactttcatgatctaacccagagtgaaaaagtccctatgtctcatctatctcctttatttccaattatcagtagaaagacaatgtttataataaataaattgagagacaaaaattattttggttgccccaaaatttaacaagaaaaatttatttaacaaatggtagcatcatttaatagctcacccagctatgattgagtagtcactaccacataaacattatatgtaattgcatgtcattcccaagatcctctgaggtctgacagtgagctggatcctgtatattgacaaacacagctgaatgcttgcttttttttttttttttttttttacattttcatcaataattttcagtctaaccctatgattacatgcttgccacctgccccccaaaataagtggtctatagccttgttagcaattcttcacaatgatacttatcatcaactggacatacttctacatttcaatttcaagatctataagtggaattttaaacatagttttttttttttcattttcagtaatgatacagaacagatgttcaccatccaaagtatggcaggctttcatatttttaatactaacttattttagccatgtgtatatatatgcataggtaagagtcattaattaaactttattgacatataaaaataggaaaaatgcacaaaagtaaaggtacagctcctttacttttttttactgaaaagtagttttactactaaaaagcaaacacttttgaaatgaaatctaattaaaaaaaaaattactagcacaacggaaatgtgctttttgttctcctaatcagtacctacctttctgctccccaaaactaccaggtatacagtatacattttttgtgtatggcattttttgctcaatgttgtgtttgccaaactcattcactgctgtatagtgtttcattgtgtcattataccaccatgtatttatccatttcattgttgacagaaacttatgttagagttcttggctctatgagtaatgttgaaatggacaaactattatttatgtctctcattcacacgtgcatgcatttctacttgttacatagctacaattggtatagctactgaataaaatgtgcttatatcctactttaatatgtaatactcaataatatttcagagtgcttgtaaaattgcactctagcaagcattgtgtgacagatgtattactccacattctcaccaacacttggtattgctagtctttttaatattagctgttcttgtgagcatgtagctgtgccacattgtagctttaatttgcatttccttgattacttgtaaaactgagtacttcttcacatatttttgagcaatttagctatcctttttctgtgaagtatctttttaggcctaatgcctaattacattggatattctggttttttttaattgatttatgtgacatggaacctttgttataatggttaatattggtaagagctgaagcactatactcctttcaagtttctgatgtgaatgatttgtccattgcttttgtttaaatcattttgctagggtttatcaatttcattgcctttcaaataatcaacttttaactttaatctttgttgctatcctctattgaataattgtttgcaattaatttttttctcttgtcttttttatttccttctttcttgaggggcaattagctgttgtttttttaatttgtaaaaaataagatcattagcttttagcctttctcattttctaacatatgcattgaaagctataaatttcactgtaaaacccataaattttgatataatttcataattttatcataatttattatttccattgggattttttttctgtgagctattggcttttaaaagttatttcttaattactacatagagggcttttctaactatctttgttattgatgtctagtttaactattactgtggccaaagaacatatttcacattattacaactcttcaaatatgttgagacttgctttatggtccaatttctagttaatttaggtaaatgttttaaatgcttttataaataatgtatatttttaagttattgaatttagtcgtctacatagctcacttaggtaaattttgttaatcagcttgttcatatcttttatacccttactgaagttttatttggtttgttcattttatacgttaataagagaagcgtttaaaatctcccatgatagctgtagatatgtatgtaactcctttaagttctatttttgttgtctacattttgaggccatgttatgaggttcatacacacatataattgtcacatcttcctggtgcattgaagtttttcatcggaaactgacccttttattatttggtaatggtatggctgatattaatataactcagtatagctttcttttggctatgtttccatggtatatcttttgcatccttttactttgagtagcctcatgttcttacaagcattatatagctaggctaaaaatctgcatctttaagttgaatatactttatttacatttgaagtaattactgttttaaattttaaatctcccatattactttctatttgccccctcctgtcctagattctcttttctcttcattcttgccttgtaaattgattttttaaaaattattctatcttctcacatatttcaaagcacccacaatttgctattttgaaatacttattgtaaaaattttagaaaatgtacgaagtgcagcaacaaaattttatcacacagtatcatttaataattatatttctttccagtcacttctttgctttaagatgtgtacataattttatatcccttcttgaaaagtatattataataatttttaatgtagctatcttttttccaaaacactatttaatagtgaaatgctaatgcattataaatggcattatggtgtgtatgtaaaataatatatgtaaaattacatgtaatatatacattacatatatgtattgtatatataactgtaaaacatttttacacatacacaattttacatattttaagtctttttgtattattaaacacaagatttcacaggtctttgcctatttcctcagaatttgcagaaattattttaaacattataaagttaaatatttctcagattcataattttaccaattattgtaattaaaattctcataaagtttaattatggatacaattaagtgaaagtcccaagcttatagttattattaactattaattctgtgtgtgtgtgtacatgtatacaatcagatcatatttgttattcttggtattctatcagatatctgtttaaagttatgaatcacaaggaacaaaatatcaaatctgatacacttcgaagtctctgtcctgtttttacacaatcaatcaatagggtggtcatatctgcaaaagtaaaagccaattaggtgaagtggaaaaagaggagtctggttgttcattcaataacaggatttccaaaataatgtttggataatggaattgttttattctgtcatcatttctaacaagtagttttaacattaccaagcatacctgtgctttgccttatgttaacaaattaggctgatcagcagccagttgttggtcccacaatattcactggggtttggcaaagggacagccaccttaaacccttctggatttgataactcaatgcacacattctcgccttctgtccatacttgtgttcctgagatcatcgcttaccccaagacaggttcaattaggatcaagaagaattcactccattctaggacttttggttgtgttgttgggggaagtaaactcttccacttgtctgctctgtggtgttatgatcccaaagcttccagggactacaaaaagggagtttaaaattgaaactgtgaaagtagaatcaggctggatgatgggaagagacatcacgtcctgaaggcatcactgagccctgaatcaagttatgcctgaagatgatgtattcctactcttctagtaaatgagtccattcctaatcttttagtacatgagtcagtaaacgcctttcttttcctgtagaccaatttgagtcagactttctgtcactcacaattgaaagtcctaacttcaaggatcctacactttccttcatagcactggtcccatgtgatgttactattacttcagtgccaacctctctcagtagactgtagtctgtatgcaaacagcagcagtatctcatttgttcagagctgcatttccaatacctagaacaattctgacccattattggtacttgatcatattgaattactgaataaataacgcaaaccaagtattttcttagccatgttcccaaaggtatgaataaattaacactatggagctatttttatgtgcatgaaagttgtttcgagatgaaaatacatacatacatatagatgtatatatacagttgtgcacttaaatttctatatagtaatcttccacagaatcaaagattgcctgtgatctctgatatgaatgaaagcaatgcctctttgttctgtgaacttggaaaaactatttctctgagtctctgtttgcttaccagtgaaaagtgcttacctcaaggtagatatttgtaaacagtagtctctcggtaaacagaattcttactagtacaaggaactaactagataaccagaagagaagagagaacaaatagtcagttcaaaaccaaagtgtttgcatggacaaaagcaaaggccagggctgcataacactgacatttttattagaattcatttgtaacaaatggaacttgtgtcagcaaagaactgattttcatacagacttctttcgccaccaatgtaacgaagtaagaaaataaaaagcacgcctttcattctgtaaaacatttacgcgtactactaattagaggtaattgtattttttaacaagccattttacaagttatttgttttaatttttcagtctatgcatccaaaacgagagcaaagaacacaactgttattatctttgtaaagacactccaagctgggatggcaaagccacataacggatggatagaatggatctgtagccttctgatctctgctggagtatcagggcacccataaacccaaaaggaaccaaaacccaaaaagaaaaacaaaaagggaattaaaaataaaaggacttaaagcaaaaccgaaaataaacaggaaagaaaaaaaatacgtgcattactgcagacttttttcccttcctgtttctatgttgtgttatttacatacacacaaatgaatttccgaagcagtttcttacagatgggttcaagtaatatcattattgggtgtagaatcaatagggcagtgcatagtacaaaggtatagaaagtgcaaagttccctagaggcccttccctcccctggctgtcctcgccgttttctaaccatgcaaatcatttttaaaaaagagctaaaataaagttctgtacaaatcactttttatatattttgattttttttaccattgtaactaattacaaaattatacataactacacgtacataggtaaataatagcaccgtactggttatgatgatgaaaataactggaaacttgaaagcttgtggtaatggcagataaagatggttcacctgggaaattaaaacttgaatggttgtacagaaaagcacagagtggaatgcacatcaatgacagtaagggagttagttctaggaacagctcctgaacagtaagattcccgcaatagtctccgcctcgttcgtctatggtatgcatcccattcattttcttcttctgattattgtcatctttccctttgccaaatgggcagttattgtttcagggagagaagctgctcattggccaatcattctggtgtgcagtgctccatcggattctacatgtccaacaaggcatgtctggatgatgcaatgtctgtctgaccccctttgtttaactaaaagaaaattatagcactgagtaatctggcacttggataaatctccaaaaagatacaaactaaaagaaaataatgataacagacccacatagtgcacattcttctctggttctgatgtaggttagagagtctcattctgaggtagccttctagatacttttttttagtattatatatattttcttttttttctttttctttgttttttacaaaagtgctcaaatacaatgcttgcaaatgtttggtctcttggatttcactctgctagcaatgggaaaatgtggaaaacaaaaatccttccatgcagaacatccatgaagctaaaattaaaccaaagtagtatactcataccaaaactctttaagagttccttgggtattttgaggattatttaaaatcatgtaatatgtggcaaacttatgccatcatccatggcttcctatagaaattctgttggaagaattgggggtaagatacatatatatatatagtttatttccccttttagaaaaatcctaatggaatatcaaatatattccaaagttgccaatgatatttgttactaaaataagtttggtgcagttactgcatgttccagagcggatttggaagggaatataaataaaacaagtagctttttctgatgttgatgattgattataaaaggaagaagggccctgattatccaagtgctttgggctggtacaatcactaacatccccgacttggctgaaaactaggaatgcatattattcaaagagtttttgtacatgtggtaaacagataatgctttaatagaaagtaacagatacgaacagtgaatggaaatacgaaccaaaagctaaaaagaaatgctattaaaataggcatcaattataaggcactctaaatgcaaaactaaaaccaaaacgaaacaaagtacagcacttcccaggaatgctgtatgccacaaaatgtttctgactgaacagagtaacatgaatttggctttgcccctgttacatatcataaatgcaaatttcatagcacatactatagacaatatacgattgaatacactttttttaaacaactcgatagctgatatattacaacattctcccctcctaaagggatatgcactgacctttcccacatgcacacctcttagctatttaataataatttttattgcactagagtgttagaaatattgaactttgttggaagcctgactaacaaacaaacaaaacaatttgtggatgtgattgattggttaggtgggggtagattaggtaggaaatcagggggtgaggtttgacaatcaatcactgatgtgcattcctcatttccctttaaagaaataccaatatgtcaaaaaattaagaataaatggaaagagatgtttacaatagcttttctacgtttaaaaaaactaaatcatggaagaactgactgactgataactgtatctattttttgtgtggacacactgtctatatatacatagacacccttataaaatatggatatatatgtatatatgttagcagcaactttatactttgcgcctccctgttgattccaaaaacaaaacaaaataataattatctttgattatttgaagagaatgggtactttctcaccaatcaaaactgaagtgtaaaattaatatatctgacgagactgatactgtagattgagttttgcacaaaaatgtgcaaattttcaaatgatttgatatttctacagcaagatattacagataacagttctacagcttaaaaaaacctacgatttggaaataaaaaaatgaagagttatgtaacttttttaaaattcactttatcgaatgatacattttgttaaaaaaaagtttacacagttagaaatgaagcacaggtcagcagtatctttacaatactaaaaaactaaatcaaggactttctttttaaacattccctcccctttccccctaaaatgttattatgagcagtatggtgggaaggggcgatgtcaaagcagagtccgtttcattgtgagaagccacaccagcacatatcttgtgctgaactgcagcattctggcaatttctccttgcacctttcaagcaatcctgaataagatggtggttctttgctgtgatttcttcttcccttgattttgaatccttgaggtatctgtaaataaaatccttcagatgcctcatcagtcaggattctcttcattatttttcaggttagattattaaactgtgaattcttggtccacctggaataatttgtttttaatttgttttgtgtgtaatagtcccactaagtagttgttagctagaagttaagaaggacttctcaagtgccctgtatggctcagaagagactccatggatattgaagggcctgtagtaaaaatccagaatgggtcaggggtttctacgttgcatagtggtcaaagctgcccaggtactctagtgcggcacgataggaaaactgatattgatcctgcaggagacaatgaatggggagaagcaaaagaagggaccatgagcatattttaatagaaaaataaaaatcaatattgcataacaaaataacatctatataggggcaaaatcactactttcgtcaactggtctaatccaatgaccaattgtttatagtgaacaaagaaaaagccacatggggtgttgattaactttgccaatcaatttgactaaaacgatctcccaattccaagcagtggcaggtcgagtgaacattaccttcccagacaagtgttttccaagtagtatcaaaccattaccaccaattgaacacataaacttcttacatgccttataagcagataatgatgaaaatcatcctttacaattatctgcttattcaagataactaattctcagtttaaatatttaagagaggctgatacagacacaaactgtcctgagaaaaatctgaatttacttatcttctgaactactgccaacagaatttgaatttttaaaaaattatgtttggacagtagagcttgcagtgagaatcactcacagtcatttcagctaccctttggctgtctctctcacttacatatgatgttcatatacagccagaaggtagctggtgcggcacaccaggcacacaaatccatttacacagggcactggacttccaagctttccatccctgaaaatggcttcacaggactggctgcccacatcaaaaaatacctgtaaattcagcccaattctgtgtgattgctagttgtctgttttagagaggcacacactaaaaaaaagcagtatgaagcatggcctttttcagacaacgaagaacactatcatattggaataaattgaagcattgttggagagatggaaaaatcacaatttacagctctctatagggatgaggaaaaggattttccccataaaagaaacctattttcagtggccaatcgggctgaaagtagacagatagtttctattttgcttaaatgtgcatttttctgtaataaaaatggttggtaatgcaaaataaatggtgtttactttcctatcttgtcacagtaagttgcttggctgagtgttaaggctttttaaatgtccaatttccctctgtaacccctaagacccattaagtttgtcaagctggcataatgttttgactattgcaagccaaacacttgcactactttgaaatccgtctgaaagatactgtggatgatgaattgaggaacacatataagttgtataatttggtggccttttgcagaacataaactctatcagtaatattatctttagaaatgaatgctcaatagaccagactggctatatcataaactcttattattacgagaaatatccaaatttccatattaattattggaataggaaatgaggggctaatattaatatctctaggcttatccagaatcaaaatgttttgaatggccattgttaagacatgaaatatagaagagctgatacctctgtaggcatacagagggagaatggagaagttaaatgggctgagattatattatgtactaaatattatgctttctatatatttatatatttatattataggactatgaatataacgaattttatgaaattgccattttattggtcaaaaatggtccagtagtaaaatttaacatagctcaatctaacatataatctcacataatttctatagcaacactaagacactaataatctcatcccatttaaaaagggggaaaatgaggttcaaaattattaaacagtttgatgctttccccacagtattttgtgtctggtgttgagagagtatggagtccgggaggtccaggctagcaaaacgtaggctcttgagatgcgaaaaatgcaatggattttctcacctctgtctgtaccatagctggtcgttgtgttcttaacattttgacagtctggaagatatctacaactccttcatatctcattctttccaaaacaatgcttagcgttatgaagactccagttcttccaacgcccgcgctgccacaataacaaaggcgatgttactgggtgagatgttcacagtcttggccacatttgcttgggtgtggacatacttctaccagcttccacactccgtatctctttatagccatattcaggaaaacatggtatcacattcatcaaatgattactcttgggatactgagttgtaacagcatgtgataatgaggatgaagtaattaggagtaagtctaataaaaggtcttttcaatggggatttataccattttagaaagaccaaggaaacataacaaatgaaaagaaagggtaaataacatataggtttataatattcatggagattctgaaatttacaacctgcctacttaatatttttaaagtatgaaataattcagaataaggtgaagtgaatttggcatcttcaacttttctatcacactgttcacattttgcagttacttaaaatacatatgcgatgcccataacctaaatgtatttgcctataactagtcaaatgtttacactggttttattatgagaaaagagatggtataacagggtatatacgtgattttcacttagtcttcaggagggtttatgactatcctgtaagtgtacgtacacatgaagtaaatactatgttgttttcttatttcttgagacttagaactttcaacagattctcacaggggtctctaatcttaaaaaaaaatggttaagagccattgatctctgaacttagctaccatttttacatgatcagcaactaaaaccacattagaaaggttttgagtttctctctgttgtcttcattgttttaagataactccagaatcttcacggtagcaagaaagaaaattaattcatagctcttgtgcacttaaggaggaaagcaatgggaagttcagataatgagggaaacagtgaataatctgaaaaatccctgcatttttggatcctaattaaacagcatgtgtaacacttgggcacgggctgtagaaaatagatggattcatttactggagggtgtagctgacaggcatatataaatagtgtgtccctttataaatggggtttctacagtctaaacagaaatgttaagtgaggtttgaaaatccaagcggagtcagtctttaagaagtgattgaagatgtctagcggcagtgaaaccttctgttaagatgaagcagatgaccttgaaggtcccttttaaccttgaaagtctctcttagttgtgagaaactgagatttattatctttttgttgaatgatctaggtactccagagtctatcttaccttgccagagtctatcttaccttgatttgatagctcgaatgcaacaaaaacattgggttactttctactaagtattttcaaaaaaagaacagacattggactcacaacttttcaatttactggttttatcatcttactttaataagttataaataagaaaagtggtattttcagaacattcctaaataagaggaaatatatagaagtcttctttgtgtgtgtgtgtgtgtgtgtgtgtgtatatatatatatatatatatatatatatatatatatataaaaggtatatgcatcgcaattcctttagcattatactaaaggaatattaaaattattttatgacaaaaacaatgagaacaggcacacataacacatttatgtacctatacatataaggatgcctaaagttaagaagatgtattaaattaaagatactcttttccttagagattattttagaaaagtttaaattagcatttgggcaaattatgagtaaagataaaagaaatatccaggtaattcaatcccaatatataccatctactttgtctgaatatgggtatacactgttttattgtgctatactttatggagttttgcagatactgtgtttttcacaaattgaacgtctgtgtcaatcttgcattgaacaagtatattggtgccatttttccaccagcacatacttggtttgtgtctctgtgtagcagtttggtaattcttgtaatatttcaaattttttcatactattacatctgttaaagtgatctgtgatcactgatctttgatgttactactgcaattggtttggggtgccatgaaccatgaccataagacaacaaacacttaattgacaaatgtgtgtgttatgactgcttcaccaaccagcagtttccccatctgtctttttctcctcaggcctccctattccttgagacacaacaatatcgaaattaggccagttaataaccctacaatggcctctaagtgttcaagtgaaagggagagtcgcgtgtatctaactaactttaaatcacaaactagaaataattaagcttaaagcccagatgtgctgaaagctaggcctctcgcaccaaacagcctagttgtgaatgcaaagttcctgaaggaaattaaaagtgctactccagtgaacacatgaatgataaggaagtagaacagctttactgctgatatgaagaaagttttaaaggcctgcatagaagatcaaatcatttacaacattcccttaaatcaaagcctaggccagagcaaggccctaactctcttcaattctatgaaggctgggaggtgaggaggctgcagaagaaaagtttgaagttagcacaggttggcttatgaggtttaaggaaggaagccaaccccataacataaaagtgcaaggtgaagcaataagtgctgttacagaagctgtagcaagttatccagaatatctagctaagatcattgatgaaggtggctacattaaaaaagagatcttcaatgtagacaaacatcattatattggaagaagttgtcatctaagactttgatagctacagaggaggagtcaatgcctgacttcagaacttcaaagaacaggctgactctcttgttaggggctcatgcagctggtgacattaagctgaagccaaagctcatttaccatttgaaaatcctagggctctcaagaattacactaaatatactcaagtgaaaggaagagttatacatctctcattttaagtcaaaagcttgaaaaaattaagttttagtaaggaaggcacgttgaacatcaagacaggctgaaagctcgacctcttgtaccaaatagcccagttctataaatggaacaagaaagaatggatgataagacatccgtttatagcatggttgactgaacattttaaggccactcttgagacctactgcttagaataaaagattcttttcaagataatactgctcattgacaacataccttgttacccaagagctctggtggaatgtacaaggagattaatgttctcatgcctgtgaacacaatattgattctgcagcccaatggatcaaggaggaatttcaactttaaagttttgttatttaagaactacattttataaggctatacattctatagatagatagtgatttctctgataggtctgggcaaagtaaattgaaaatttactggaagtaattcaccattctatatgccattaaaaacatttgtgattcacgggagaagatcaaattatcaacagtaacaggagtttggaagaagttgattccaatcttcatggatgactttgaggggttcaagacttcagtagaggaagaaattgcaaaaatggtggaatagcaagataactagaactagaagtggagccaggagatgggactgaactgctgcaatctcatgataaaacctgaatacatgaggagttgttccttacggatgagcaaagaaagtggcttctcaagatggaatatactcatgaagatgctgtgaacactgtggaaatgacaacaaaggatttagaatagtacataaacaaagttaatagaaaagcagcagggttgcagaggaatgactccaattttgaaagaagttctactgtgagtaaaatgctatcaaacaacattgcatggtgcagagaaggctcttgactttgtcacttagtcacttgatgtggcaaacttcattattattttcttttaagaaattgctacagccacctcacccttcagaaaccaccgcccatcgattagtcagcagccatcaaaatagaggcaagaccctcaaccagcaaaaagattaaaacttaccggaggctcagatgatgattagcatttttttttttttttaaactttaagttctggggtagatgagaaaaaagtgctggtttgttacataggtataaatgcaccagggtggtttactgcacccatcaacccatcatctacattaggtatatctcctgatgctatccctcccccaggcccccaccccctggcaggccctggtgtgtgatgttcgcttccctgcgtccacgtgttctcactattccactcccacttataagtgagaatatgcggcgtttgattttctgttcctgtgttagtttgctgagaatgatggtttccagcttcatccatgtccctgcaaaggacatgaactcatccttttttatggctgcacagtattccatggtgtatatgtgccgcattttctttatccaatctatcattgatggacatttgggttgcttacaagtctttgctattgtgaatagtgccacaataaacatatgtgtgcatgtgtctttgtagtagaatgatttacaatcctttgggtatacactcagtaatgggattgctgggtcaaatggtatttctggttctagatccttgaggaatcaccaaactgtcttccacactggtttaactaatttacacacccaccaacagtgtaaaagcattcctatttctccacatcctccccagcatctgttgtttcctgactttttaatgatcgacattctaattggtgtaagatggtatctcattgtggttttgatttgcatttctctaatgaccagtgatagtgagcattttttcatatgtttgtctgccgcatcagtgtcttcttttgagaagtgtctgttcatatccttcgcccactttttgatgaggttgttgttttcctgtaaatttgtttaagttctttgtagattctggatattagccctttgtcagatggatagatagcaaaaatttcctcccattctgtaggttgcctgttcactctgatggtagttttttatgctgtgcagaagctctttagtttaattagatcccatttgccacttttggctttagttgccattgcttttggtgttttagtcctgaagtctttgtgtatacctatgtcctgaatggtattgcctaggttttcttctaggggttttcatcattttacatcttaggtttaagtctttaatccatcttgagttaatttttgtataaggaagggatccagtctcagttttctgcatatggccagccagttttcccaacaccatttattaaatagaggagcctttccccattcttgttttccctcaggtttgtcaaagataagatgtttgcagatgtgtggtgttacttctgaggcctctgttctgttccattggtctatatctctgttttggtaccagtaccatgctgttttggttactgtagccttgtttgaagtcaggtagcatgatctctcaagccttgttctttttgcttaggattgtcttggctttgtgggctcttttttggttccatgtcaaatttaaagtagttttttcccattctgtgaagaaagtcattggtagcttgatggggatggcattgaatctataaattaccttgggcagtatggccattttcacgatattgattcttcctatccgtgagcatggaatgttcttccatttgtgtcctctcttgtttcattgaacagtggtttgtagttctccttgaagaggtccttcacattccttgttaagttggactcctaggtattttatcttttttgaagcaattgtgaatgggagttcactcgtgatttggctattattggtgtataggaatgcttgtgatttttgcacattgattttgtatcctgagactttcctgaagttgcttatcagcttaaggagattttgggatgagatgatggggttttctaaatatacaatgttgtcatgtgcaaacagagacaatttgacttccactttttctaattgaataacatttatttctttctgttgcctgactgccttggccagaacttccaatactgtgttgaataggagcagtgagagagggcatccctctcttgtgctacttttcaaagggagtgcttccagtttttgcccattctgtaggatagtggctgtgcgtttgtcataaatagctcttcttcttttgagatacgttccatcagtacctagttttttgagagttgttagcataaagggctcatgaattttgccaaaggccttttctgcatctattgagataatcatgtggtttttgtcattggctctgtgtatgtgatggattacgttcattgatttgtgtatgttgaacaagccttgcatcccagggatgaagccgacttgatcgtggtggataagctttttgatgtgctgctggattcggtttgccagtattttattgaggattttggcatcgatgttcatcagggatattggcctggaattttcttttttgttgtgtctctgccaggttttggtatcaggatgatgctggcctcataaaatgagttaggaaggagtccctctttttgtattgtttgcaatagtttcagaaggaatggtaccaattcctctttgtacctctggtagaattcgtctggtcctggactttttttggttgctaggctattaattactgcctcaatttcagaacttgttattggtctatgcagagattcaacttcttcctggtttagtcttgggagggtgtacgtctccaggaatttatccatttcttctagattttctagtttatttgcatagaggtgttgatagtattctctgatggtagtttgtatttgtgtgggatcagtggtgatttcccctttgtccttttttattgtgtctgtttgagtcttctgtcttttctatctattttgttgatcttttccaaaagccagctcctggattcattgattttttgaagggtttttcgtgtctctatctccttcagttctgtagtgttcttagttatttcttgtcttctgttagcttttgaatttgtttgctcttgttactctagttcaattgtgatgttagggtgtcgattttagatctttcctgctttctcttgtgggcatttagtgctataaatttctctctacacactgctttaaatgtgtcccagagattctggtacattgtgtctttgttctcattggcttcaaagaacatctttatttctgccttcattctgttatttacccagtagtcattcaggagcaggttgttcagcttccatgtagttgtgtggttttgagtggtttttttttttaaatcttgagttctaatttgattgcactgtggtctgagagactgtttgttatgatttctgttcttttgcatttgctgaggagtgttttacttccaatatgtggtcaatgttagaataagtgcaatttggtgctgagaagaatgtataattctgttgatttgggtggagagttctgtagatgtgtattattaggtctgcttggtccagagctgtgttcaagtcctgaatgtccttgctaatgttctatctcattgatctgtctaatattgacagtggggtgttaaagtctcccactattattgtgtgggagtctaagtctctttgtaggtctctaagaacttgctttatgaatctgcatgctcctgtagagggttcatatatatttaggatacttagctcttcttattgcattgacctctgtacgtaatgcccttctttgttggtttaaagtccgttttatcagagactaggattgtatcccctgctttgttttgctttccatttgcttggtaaatattcctccatccctttattttgagcctatgtgtgtctttgcatgtgagatgggtctcctgaatacagcacactgatgggtcttcactcctctttatccaattggccagtgtgtgtcttttaattgggggcatttagcctatttacatttaaggttaataaggttatgtgtgaatttgatcctgtcattatgatgtttgctggttatttgactattaattgatgcagtttcttcccagcatcgatggtctttacaatttggtgtgtttttgcagtggctggtaccagttgttcctttccatgtttagtgcttccttcaggagctcttgtaaggcaggcctggtggtgacaaaatctctcagcatttgcttgtctgaaaaggattttatttctccttcacttatgaagcttagtttggctggatatgaaattctgggttgaaaagtcttttctttaggaatgttgaatattggccccactgtcttctggcttgtagggttgctgtcgagagacctgctgttagtctgatgtgcttccctttgtgggcacgccgacatttgtctctggctgcccttaacattttttccttcgtttcaagcttggtgaatctgatgattcattgtgtgtcttggggttgctcttctcgaagaatatcttagtggtgttctcagtatttcctgaatttgaatgttggcctgtcttgctaggttggggaagttcttctggataatatcctgatatcctgaagagttttctccaacttggttccattctccccttcactttcaggtaaaccaatcaaagtaaatttggtgttttcatatagtcccatatttctcggaggctttgttcatttctttttactcttttctctaatcttgtcttcatgctttatttcattgagttgatcttcaatctcggacatccgttcttccacttgattgatttggctattgatacttgcgtatgcttcacgaagatcttgtgctgtgtttttcagctccatcaggtcatttatgtttttctctaaactgcttattctagttagcaattcctctaaccttttttccaggtacttagcttccttgcattaaattagtaacatggtcccttagctcggaggagtttgttattacccacgttctgaagctgacatctgtcaatttatcaaactcattctctgtcctgttttgttcccttgctggcgaggagttgtgatcctttggaggagaagaggcgtgctggtttttggaatgttcagcctttttgtgctggtttctccccatcttcgtggatttatctacctttgacctttgatgatggtgaccttcagatggggtctctgggtggacgtgctattcctttctgtctgtctgtttgttattttccttctaacaaacacccaggcctctctgctgtaggtttgctggaggtctattccagacgctgtttgcctgggtattatcagcagaggcttcagaacagcaaagattgctgcctattccttcctctggaagcttcatcccagaggagcacctgccagatgccagccagtgttctcctgtatgaggtatctgtcagcccctactgtgaggtgtcacccagtcaggatacatgggggtcagggacccacttgaggagagagtctgtcccttatcagagctcgaacactgcactgggagaaatgctgcgctcatcagagctgccaggtggggatgtttacgtctgctgaagctgtgcccacagctgccccttccgccaggtgctttgtcccagtgagatgggggttttatctgtaagtaagtctgtgattggggctgctgtctttctttcagagatgccctgcccagggaggagtaatccagagaagcagttggccttgctgagctgcagtggactcagccctgtttgaacttcctgctggctttgtttacactgtgagggtaaaacaaacagcctactctagcctcagcaatggcagatgcctctcccctcacgaagctcgaatggcccaggtggacctcagacagctgtactcgcagtgagattttcaagccagtggatcgtatcttgctgggctctgtgggagtggatcgtatcttgctgggctctgtgggggtgggacacaccaagccaggcactggagggaatctcctggtttaccagttgtgaagactgcgggagaagtgcagtatctgggccagagtgtactgttcctcgtggtacagtctctcacggcttcccttggctaggaaagggaaatcccctgaccccttgtgcttcctgggtgaggcaacgccacaccctgctttagctcaccctttgtgggctgcacccactgtccaaccagtcccaatgagatgaaatgggaaacgcagaaatcccctgccttctgtgtcaatctcactgggaacagcagaccagagctattcctattcagccatctttccagctcttgtaagtacattgttgtttgtttagacctaatgctattgcacactaaatagactatagtataaagtaaacacaacttttatatgcactgggaaaccaaaaagtatgtgtgactccctttattgtggtaatctggaactaaactcccataacgtctctgaggtatgcctgtatttgattccatgtgtcatttcctacaagctctttggttggtttgcaaaggatgtttaataactcaatagaaagtagaaagcaaatgtacatagataaaggtttgcttcttataacatgcctgagaaacaaaggatgctagaagggactttaaacctcagctaagataactgaagtccagagaaacttcattatcatagagccaaataatagaattgagattagaacacagctatcttagcccaagtctaatatttgtcctattttgagatcctgccttctatgtcgtaaagaactatagttttctttgatgtgctgaagcaaaatatattttttaataaactctctcaagagtttcaccataaaaagattagatgtcaagttgccagaaccctaaaatatattagtttaaataaaattagatgaattgcttttgttagaaggtttttgcatagcaacttccaaaaacactaaatttatggtgaatgtctgaactatttacttgctatttatttctattaacttcaatgacttgagttataaaatgctctagaaactattgaaaataattaacttgaaggtgcttcattttctgatatagcaacaattttcaagcaaattgcattttttaactgaggtaccatactaagcacttattgactggcagaacttaatattgtcattaggatttatttgatagctattcatgaggttttcacaaacagaagaaagacagttatcagtgcattgctatgaaagcaaaagcaaatatgaaatgattaacaacgaattattactaggggaggtaccaacaattcccattaaggtaaaattggtaatttggtttgtctaataggaagcaaattttttgggggataaacatttttttggggctaaacattttcctctgattattttcacttattttcactttatgaaaagaaagagaaatcaatcctgctttaagttttgtaatacattgccaagaataaaatttcaaataagcaaacttactacaaaaagtgtatacagacaatgaagaaacaccaccacttatcactgctttattcacaaatggaaacttacctgcaatggactgaaatgggtccatcttggccaaactgttcttttgttttatggacttggccgatgaagtcaataaatccttctccggactttggcactccttgctctggccagtcagtgaactggaactgccttactgttcgggactggccgtcctttagaaggaaagccacatacccggccgcaaaggaagacgccaggaggattcagcaagcatacggaccacaagaacaatcattttcatttcccgaaaacaaaaagggtagaaaaagttaggaacatgtttaaatagaaacttagttatggtttatctgctataaatattgtccacactcacatacctttaaatcctaaatttatttactcttgaaatcctaaatttatttactcttgcagtgcccagttaaaaacctggttctcgttagtagccatccacatagttcccccattaacaaatgtttctgagacccaaagtgggggttcgtaaccattcatcatgtctgcattccttccaaaatggaacatataaaatggaacatatatattccatttcaaaaatttcagaaactaattactttgtaataaatattgaaacaagcacctaggcatgtcatccagaccagagcttttgcagttgtcgcaataacttcacatctgctgtgcttgcgtatttctaccgttgtcaaatgacaaatggtgaaatttaaagtatctgacacaaacccggtagttgctgttaacctggatgccccccatgtctcagaggaataccatttctagccatggcaggggacatagcatgaaccatatgactgtgctgttaagtgggaagtaaagcatccctcaaggataccaacgactattagcaaacaaatgcccttttctgaaaaagagctctccctggctgaccacaggaattaacagtctgtggagagctttaacatagataaaccaaaaggtagaaaaaaaagccagattgaagagcagtctttcttttttagagtgattaggtaaaactgctctgactcacgaagtatatctgggttgaaaagaagacactaaggcatttctgatcttctgatcccttgtggaaatttaaggtgtttctagaagtacaagaaaagtggaagggagcctctgtttatagaagcagaaataatacattgcccatcaaccttctcccctgactcatcagcagagagaaataatccaagcttagagagaccgatctcatttctcatttgaagaggtcctactcctaaatggtctcttctcattaaagagccttcaacttgttcctccattgtttctgttaacacattatttcctcatcaaactttttttagatacacgtgtgcatgttcccaaggttctgggtaagtgaacagggactcaatcctttatcattcactcatattgagaagagagaggatctcagtgtgagatgagcactcatcacctcgcctggtggttttcacagggacatgccagattcctgactgatgttatttggggatggagataaacaggaagatgacaccaagtgtgtgggaatactgagaaatagagaaaactatttggccccataagtactttatggatggttaccatggaagcatgatttacttccctctgtttctggaaaagatttggaaagcacaggaaggagacccagaagctaggtaatacagatttattctcctctgaatgtcctggggatttcatttctgaccacagttgctttcaatagcaagaagaggtcatgtgtgcaaataccttctatttggaggagagactgcctgacttcatttaaaggttacctgtttaacaatactgtaattttcaacccagaattgcatatccagccaaattaagcttcataagcaaaggagaaataaaatcctttacagaaaagcaaatgctgagagattatgtcaccaccaggcctgccttacaagagctcctgaaggaagcactaaacatggaaaggaacaactggtaccagccactgcaaaaacataccaaattgtaaagaccatcaacgctatgaagaagctgcataattaatgggcaaaataaccagccagcatcataatgacagaatcaaatttgcatataacaatattaaccttaaatgtacatggactaaatgccccaattaaaagacacggactggccaattggataaagagtaaagacccatctcacacgcagagatacacataggctcaacataaagggatggaggaagatctaccaagcaaatggaaggcaaaaaaaaagagcaggggttgcaatcctagtctctgataaaactgatgactttaaaccaacaaagatcaaaagagacaaagaaggccattacataatggcaaagggatcaatgaacgaagaagagttaactatcctaaatatatgtgaccccaatacaggagcacccagattcataaaataaagcaagttcttagatacctacaaagagacttagactcccacacaataataataggagactttaacaccccactgtcaatattagatcaatgacacagaatattagcaaggacattcaggacttgaagtcagctctggactaagcagacctaatagacatctacagaactctccaccccaaatcaagagaatatatattctcaacaccacattgcacttattctaacattgaccacataattggaagtaaaacactcctcagcaaatgcaaaagaaagaatggaaatcataacaaacggtctctcagaccacagtgcaatcaaattagaactcaagattaaaaaaaaaaccactcaaaaccacacaactacatggaagctgaaccacctgctcctgaatgactactgggtaaataacagaatgaaggcagaaataaagatgttctttgaagccaatgagaacaaagacacaatgtaccagaatctctgggacacatttaaagcagtgtgtagagagaaatttatagcactaaatgcccacaagagaaagcaggaaagatctaaaatcgacaccctaacatcacaattgaactagagtaacaagagcaaacaaattcaaaagctaacagaagacaagaaataactaagaacactacagaactgaaggagatagacacacgaaaaacccttcaaaaaatcaatgaatccaggagctggcttttggaaaagatcaacaaaatagatagaaaagacagaagactcaaacagacacaataaaaaaggacaaaggggaaatcaccactgatcccacacaaatacaaactaccatcagagaatactatcaacacctctatgcaaataaactagaaaatctagaagaaatggataaattcctggagacgtacaccctcccaagactaaaccaggaagaagttgaatctctgcatagaccaataacaagttctgaaattgaggcagtaattaatagcctagcaaccaaaaaagtccaggaccagatgaattctaccagaggtacaaagaggagttggtaccattccttctgaaactattccaaacaatacaaaaagagggactccttcctaactcattttatgaggccagcatcatcctgataccaaaacctggcagagacacaacaaaaaagaaaattccaggccaatatccctgatgaacatcgatgccaaaatcctcagtactggcaaaccgaatccagcagcacatcaaaaagcttatccaccacgatcaagtcggcttcatccctgggatgcaaggcttgttcaacatacacaaatcaataaacataatccatcacatacacagaaccaatgacaaaaaccacatgattatctcaatagatgcagaaaaggcctttggcaaaattcaacaccactttgtgctaacaactctcaataaactaggtactgatggaacgtatctcaaaataagaagagctatttatgataaacgcacagccactgtcataacgaatgggcaaaaactggaagcattccctttgaaaactggcacaagacagggatgccctctctcaccactcctattcaacacagtattggaagttctggccagggcaatcaggcaagagaaagaagtaacgggtattcaattaggaaaagaggaagtgaaattgtctctgtttgcagatgacatgattgtatatttagaagaccccattgtctcagccccaaatctcaagctgataagaaacttcagcaaaatctcaggataaagaattaatgtgcaaaagtcacaagcactcctatataccaataacagccaaatcatgagtgaactcccattcacaattgcttcaaagagaataaaatacctaggcatgtgaaggacctcttcaaggagaactgcaaaccactgctcaaggaaataagagaggacacaaatggaagaacattccatgctcacggataggaagaatcaatatcgtgaaaatggccatactgcccaaggtaatttatagattcaatgccatccccatcaagctaccaatgactttcttcacagaatgggaaaaaactactttaaatttgacatggaaccaaaaaagagcccacaaagccaagacaatcctaagcaaaaagaacaaggcttgagagatcatgctacctgacttcaaacaaggctacagtaaccaaaacagcatggtactggtaccaaaacagagatatagaccaatggaacagaacagaggcctcagaagtaacgccacacatctgcaaacatcttatctttgacaaacctgagggaaaacaagaatggggaaaggctcctctatttaataaatggtgttgggaaaactggctggccatatgcagaaaactgagactggatcccttccttatacaaaaattaactcaagatggattaaagacttaaacctaagatgtaaaatgatgaaaacccctagaagaaaacctaggcaataccattcaggacataggtatacacaaagacttcaggactaaaacaccaaaagcaatggcaactaaagccaaaagtgacaaatgggatctaattaaactaaagagcttctgcagagcaaaaaaaaaaaaaaaaaactaccatcagagtgaacaggcaacctacagaatgggaggaaatttttgctatctatccacctgacaaagggctaatatccagaatctacaaagaacttaaacgaatttacaggaaaacaacaacctcatcaaaaagtgggcaaaggatatgaacagacacttctcagaagaagacaccgatgcggcagacaaacatatgaaaaaatgctatcactggtcattagagaaatgcaaatcaaaaccacaatgagataccatcttacaccagttagaatggcgatcattaaaaagtcaggaaacaacagatgctggggaggatgtggagaaataggaatgcttttacactgttggtgggtgtgtaaattagttaaaccactgtggaagacagtttggtgattcctcaaggatctagaaccagaaataccatttgacccagcaatcccattactgagtgtatacccaaaggattataaatcattctactataaagacacatgcacacgtatgtttattgtggcactattcacaatagcaaagacttgtaaccaacccaaatgtccatcaatgatagattggataaagaaaatgtggcacatatacactatggaatattatggtgagtgagtattccataaaaaaggatgagttcatgtcctttgcagggacatggatgaagctggaaaccatcattctcagcaaactaacacaggaacagaaaaccaaacactgcactcaaaagtgggagttgaacaatgagaacacacggacacacggaggggaacatcacacactggggcctgttgcgggtttggagtctaggggaacgatagcattaggagaaatacctaatgtagatgatgggttgatgttgcaccaaaccaccgtggcacatgtataattaaattatgtaacaaacctgcatgttctgcacatgtattcaggacttacactccaggagcacagacaaacagcaaatgtagtagctaagaaaattatacaatcacagggagactttaaaaaaaaaaaggtgagcaacttccggtttcaatcttcttttgtttattgtgatcagatttaagttgtgcatgtgtggaataggaaaggtgtctctgccattggtggggcctggtgccttttctttatcaccaggaatagttggtgagtttactcaaaatgcactttctattttcactcacatacctagcttcaaattctgaaagagcactattttttttttttttaaacggtggggcaggttacactcaagacctagagatttaactgctgccttgaatactgtcaccttcagaatagttaatataactttctgggattaacaggtctgtcacctaggccaaccctcctgctaaccaatttctctttcacttaaggtcaacagccagggccaggctttggggattagcagacaatctccaaacctaagtttggagaaagctgctttccagaaaaaacaatggatcaactaaatagctttaccctggagttttattcaacccacccactgtgacagttccaaacacaaggcaggtctttgaactgacctggtctcccttaagatgtgtttgtaatcatgggttgaaagtggccaaaggcgaagatatcagagtttatgcatagaacatcttacatcagggctgaaccttggactcaacaatccagataagaaatgcaggatgaaaattagccaacaagggtcatgggagcacagctctcatggacagacacattagcacactgaggaataagccatgccaggaatcaaattagaatgtgcaaagcttgtcagatttttctaaagaatgccatttgctctgcggttttaaaatcataccaaattaacctctgggtccatatgacctaaagggctttgcaaaacaacaacatatttagagcctcaagtaatgaagaagtcaaaaaagctccaaagagcatgagctgagaaggtgaatgtaagcacagccaaccaatcagtaaacacttcccagcacgaacactcaccaagtgcatccccaaggttgagctgccagatgttatgtttgaatgaaagccaaactaaggtttgtgagaaagcttgccagacagaggaaaagttactcttacatattaaacataaaaaaaaacgttctccagaatgaatgatttctctttgggacaacagtcaagtggcaagtgcttctcccagagagagagagagagaggtatcttagactacttttcagctaatggttaagagttgaagactgtgccaacttaccctggcatctgtgaccttgaattcccttaggatatactgtggcatgttgtactcagccatgggatctacaacaaagtactggtatcttgcagaccgttctgctggccagtattggtgacatttctcctaaaaggagagaagattaatgttaaactatgcaaagtataaagaacattctgtatattatctatctatctatctaatctatctaatttccttatcccattaataaaatttcaaaattcaaggcaattccaattgcatatgactcatttcctcttagaaaccatgagctcccttcatagggaaaccctttggttcagtatttgcctatggcatccagcacggtctctggcagatagtagctgcttaatatacacgagttgaattgagaattgaatactttcatagggtaagcatcttcatacctacaagttatccaaataattacatcagtccttggacaatgctggccatgacaataacacattgcaccaccacagcatacttgcaccactatggtttggaatgaagagaaccatcagtatggacatagaaagaaacctccgaattgatttgttccaatcttacttgtcaaggaaacgaggggcccagtccattttaatgacttggctaaaccctgcagagtcattggccaaatcagagtaagtcagttactttcctcgtctgatattctttttgttctctccgggggctctacaagttgggctttagctgcacttctatttaatttacacaaagaagacagaaagaaaatatctgaagcaaatacgaaataatgcttacatcaagtcaatctaagaggtatctctaaataatattaggtcatagtggtagagcagtattaatagtagaaaccttaagtatttctaatactattttatgtgtatttcaaaaaaaaacaaaccacttttttcaaaagtggatctgggattaccaggttatatccttagaaaaactatgttgctttccaacactttattcaatgggagtgaaaggtaggcaagtaagaatttgcctcaggaagaaaagaaagtcaagttccttcataagtagaaatgatggcacatcaaactctagcctgtccagaacaaaaggcagtaagaatatgctaaaagaagtccgacataagtcaaacggggacacctgctactcatttgtctccatgcttgtgcttcactggaaacaaatcactagatctttctttaaaacacataaatttaaacacttgatgtggctttacaaatttagaaactaacaaggaatgatggtccggattatgtccagagtgcactgcatttcaaaaaaaatgatctagcacaagagttattgaaacaaagtcttcatttctccacagagtaaatgtcttatgaggagacacacaagggccacacacttactctgcccatttcacgcagcttggtgagcatcacaactatggtggaattgtgttcccagagcatccgccagaagtcttcagtggtctctgccaagggcccctgggtagcgatgtaggctttctgttgtctgaattacagagaatgaaaagaatgtgttaaagtatttagagaacatgcaaaagctcacactggatacataaacatcaacctgctaataaaaaacgaaaacatattattaatgcaattgaggtaaattcctgctaagattaaataatcaaataagagcatttaatacattttggggacttcgcaaactaaattgcttgttaatattatgatgtatgtctttatcattattatttgaattttagcgcaatgctaatagctcaatttcattgtcatacaaattacttaagaaacacttagatgtgcagcttcattttctagaaattattctcacacaatctattaaatttatgaaatatggtacaaaacagattctttattaactacttacatatccaattggcttatgaaagaagagtgcagaaggccagattaaacacttcataactactactcctaactcctatccaaaataacaaaaaaacaaataccaagggactaaatgatgacctatgcagaaagaaaatgtctttgaatggagatgaaatttattctggttattaaactagggcacatgtaaatatcaaggctttggatagtcaggggagcaaaagtagatacctgtatccatcaataaaactggcattgatgtaatcagatccttctactccacggataggctgcaggcatacccttgtggattcatatggcataatattaacaaggcgatttttgaatttattacatggaagattggcactgataaaccttgaggtgtgagcttttgagctggctagacgctgttgaataggaaaaaaaaaaaaggaaaaacccaacaaagatcattttcacctacagtttgaatgcagtgtaccccagatttcccttttagatataaatcttttgtttacttaaagtaaatgactattcaaattgtactgcttttcacatctacctaatcactctctatagcctattggatttctatatattttctgaaagtatagtctctcaagttaggagacataagggctcaagatattgttaggaagcaaagaatagaagaggaaaaggggaggaatacattttataatcatacacctgagggaaaggtcaaatgaatcttgtacttcacaaatttgaaaggttaaagtaaagccacgactcaaagacaaacccagaatgacttgctcctgaataaccacatcacatccaataccataccttaaattcgagctccattcctgtgacattctctcccgtttctatttgtgtcagcttctgaatgtaggcatacaagtttctagctggcacttcggtatttccacaagtcactgcttctaacagtgcatcatggataaagatgtattggtcttctgtttgaaccatatagttcctctgggctctcattaaagttacatggccataaatatctacagttttttcatgctttattctttctaacatggcatctatgacgatgaagcaaccagtccggccaactcccgcactatgaggaaaatagagaagaaaagcccaaataaacctatcagaaaatcaatacataataaaagtatttttattattcttattaactagaccttacatccattacttctactcaaatagctattgggatgactttgtaatactctaaagtcaaaagtattatctaggcaccataatcagaggacagggaacaaaagactgagtaaaattagtttagttttaaaatgtaaaaaatattaaatccataatcactatgttccttgatcatgcaatacaaagtgaacattatttcgaaaacttttgaagtcattatgaaaaaaatacaaacatttagtctgtccatatttagaagatagttttatatattggtccagatctggctaggctatagttcttgcaaactctctcaatctgttttcgtcccatgtacaaaacataaagattgtttttacagtctcaagctaaacctcgcatgcttcctatttatcaaacccttcaggctgaggacatttatgtgtcaagtatggttcaatccaaaatactttctcttcctgatcatgcgggtttatcaggctggtaaacatgtcatcaacaggaataggtatataataggtgtatattaccatcttaggtaacaggcaacagacagcctccttcatttgctacatgctatgtttcctgtcatctgtgtatctatgtgttcatttattgtccatccctcattgatctgtccatttcttcattcaataaacaatgaagtactctgctaagtgaaataggggatacgacataaagatgacttagatgctatctctaaagagctcagagtgtatcgaagggacataatactttatacacagctatttctaaacaagaaagaaaaaggatgtattagttttgtatatgatgtggcatttgaagtaggacttgaaggacaggaaggatgaggaattaaagatgttgtagtatgaacaaaggacggatggctttggtaatcacactgctggctctgggagctacatgtgaaattttcataggtctggcaaggcacctttgcaacgaagataccagaactccaaaacaaatgagttaatgctcaccagggtgcctgtctcaactgaaatggcagtttctgtttggtatcatagtggctgcaaggcagtaagagatcattttttttttaaacaaaataatacctttatttaactgctgaacagtgtatatcaaagctagcttgcatacaggagctctgtggtttacagactgggctaactagctgggaatttgatataaccactactttaaaataggttacttttttatgtcctatgccagagggctcctgaatactgatgccaagaatccaatcccaagtataaacccacaaattgacatgacattgatatatcatgcaaaagccttctgagacagagagtcctacaaatgatagcacataccttagcacagaccaattggcaacctgatgcaaacattaatatagagcaaagtcggcctggtggttccagttccttgagatccatgaagtctcattttatttagttggttctaaagaaacctgttagatggcgagttttccctgacattccccattcctaccctcccaggtggttttaatcatcctctgcctcagatccctggttgccctcaaatacccctttactacaattctaaccaaattatattattaatttagggcagccatccataaacaacagcatacatcttgagagcaggaactgcattaaaaaaaatatttgtgtgccctacacaaagcatgcagtaagtgctcaacagtgtttgtgaaataagtaaacaaattagtgactggcttgagatgcctgcagtaatgagcagcccgtcccggtaaggtaagcctacttaggaagcaggactcttcagaccatgcaaaatcctacatttgacaagggtttggaattatgtaaggagtacccgaggactcctctgcatagtgtttgatcaggaataaagagacaggaaaatcactttaagtagtctctttgctggtctcctgatatgccatcagattgcagttaaaggaacctaagtcagactcaacctggaaaagatttgtctttctgggtttctttcaaactccatgtttggcaggtcctgagactccaagtaacatctttcgttctttctgtgttgtctttctaaattgtcttcattgcagctgtgaatcgtttctcatggacacagttttatgcagttcttcccagtggaaaccacactgtaaaccttagaactgagccctatacatcaagtcaattctagataatggcaggactattttctcaaaatatgcatcagggaccattcaaatgtctggatgatgcatggttctatattctggcagaaagatactacagaatcttgcaaaattggtaggaataactccaactctaaacagtatcaaccttttcataatggtgattttttttttccaaaaaataagggaaaaaaatcaaatacgtgtgagtccaaatcatgaattgtgggatgaaaagaaataacagaggctatgacttgaacaaaacctattttttcccccacaattcaaaatattgttaactgcccaatcctgctattcatatggaagatagggaaggagctgacgtttggaacttaatgtgttaccttcttctaggatgaagaattcttgagggatttaaacattaaataagtgttttcgcttgaagcaagaccttgaggcttaaggtacctcttcagacatcaatggctgtgtgtccttgagaaagacattttaaccccttccttatattcccatatttcttaaatgatagtgacagttaactcttattaacgttaattttctagtgagtctaattatccagtaagtcttaaggctaaattaaaaataccaagtgttttgcaaacataatggaaaaggcagttactttctaggtacaaactccattttaacattcagtctctaaagctgacaatgagaaacaagcaatgtaatgctgggaaaattatgacagaattactttagaaacatttgagatttggcttttaaaatcttgctttcgtctactctctcaagctgctcttcctttcctctgccttctttccaataaatgtgccttatacctgaggagctttctgcgttcacatttatcatcgtggcaaatgagatggcaggcaagggccttcctaccacagtgcttgacacctaagaagcattcagtaaatgttggtttcctttccccttctctgacaacacttgggaactgccctgaagtcctacagtcatgcacgccatacctggatagcagagaagactcaaatgcaggttctgaggtgttaaaatttagcaccctgttcccagcacccccagtgcttcacaatgctttccaccatttaggtcagcagtcattgccaaatatggtgactttcctgtagagcgctcgtctgtgatatttcattggcagcatttgactatccctaatgcaggttcctagaaaagctttctatccttggttttaaggacactagtcaagggagtatgggaaacatcagatactcccttggggttaatggtagcaagggtggagattgtgtcattactccagacacaaaataatccaaaacaggtagtacacgaaatcagcccaaaataattgtatcatgatcctgtatcacggttccattgattctgtaacagggtagaattcctaccacgtttgaaatcgaaatcaaagatgaactctaaatgtcatcttcagaaatctactggcatccgttcagactgtgcctcagtatgtttcgttttgttttttttatttgactccagtgctaattctctacctgcctctctggattcttccatctgtatcaatttcacggattacatatctctgccagtccccaaaatgtagataatgctccaaaagttctgtccttctttctctcagtagtagtctccaaaggattcctaaagtgatgcctttctttttcagcacaagtggagatctatatttcaaactgtcttcaagtttatcaaaaataaagattctaagcttaatcagtatcttctcctttcaaatctgctcctcccactctcaggctctccttgacactcaggtttaaaactgaaaaatcatcttagactctttttgcctcttaccctgcaaaataataaattataaattgttatgtattcaaactccacgattatcttcaactccccatcagtggtgtgctagagctagcaaaagccaatccttacattttcagggattatttgctgaaataaatatattaaaaataaaggtaatatataaaactcattgtttcttaattgtttcaaattattttatgctcttgaggtgaaaacatcatatagagtagtccccttttatctgtggttttgactttctgcaatctcagttatttgcggttaaccacggtctgaaaatattaaatggaaaattccagaaataagttttcaatgacatacttttctgaaaagtgtggtgaaatctcaagccctccctttccatccagcccagggtgtgaatcaatccctttgtccagtgtatccatgctatacaggctgcctgcctgttagtcacttagtagccatctcggttatccgatggactgccctggtattgtagtgtttgtcttcaactaacccttattttacttgatggccccaaagtgcaagagtagtgatctgggcaatttggatatgccaaaaagcagctgcaaagtgcttcctttaagtgaaaaggtgaaagttttcaataaggaaagaaagagaaatcgtatgctgaggttgctaagatctatggtaagaatcaatcctctatatgtacaattgtgaagaaggaaaaagaaattcatgattgttctgctgttgcacctcaaactgcaaaagctacggccacagtatgtgataagcacttagttaagatgaaaaaggcattaaattttgggtgaaatacatgaacagaaacatgccatgactgatggcaagtgagcttggtactctctggggactcaggcatccactggggatgttggatcatatcccctgcggatagagggggactacactaataatgtgctggtgatcgtctctctctagtgacctcatgtttgtagcttgaaatcatccatgggaatatttacaccaaagaaatcaggaaatactactttttttctccccagagagcaggtttttacatatttaccagcacatatgactatgctaaagcatccattcccaccatccagggacaaagaggaagagttcctaactttgttcttccatccatatttgttgtattttcatgactctgtcgcctactattccacaaacatttactgagtgcctaccatgtgctgagacatcgaagaaggaatgagcagaacaaacgtgatctttcctgtcggagcttacagtttagtgggggaatctgacattaaataatcacatgaataaacatctaattacaaatctcaagcggcgctgtgaggcaaatgtgaaggatgctggtagagcacctttgaggaagtgccattgaaactgaaatctgttatgggctgaattgtgtttttcttctcaaaattcatatgttgaaacgctaacccccagtgtgactgtattggacacagggcctttagggaggtaattaaggttacatgaagtcacaaggtgggagctttaatcagataggatggatgtccttgtaagaggaagagacaccagagatctttttctctatgcatacacagaggaaaggccgtgtgacggcacagtgagaaagtagtcatctaaaagccaggaagagaggcctctcctgaaaccaactctgccagcaccttcatcttggacttccagcatcctgaatggtgagaaagtaagtttctgttgtttgagccactcagttcggagtattttgttatggaagccccagcagactaacgcaatacctaaaggtcaagtaactgtttgctaaataaagagggtggaaaagcttttgaaaagatatcctaaaaaaaagtgctagaatagacaacatagcacatttgaataactaacagaaagccatcggctgaaaggcagtgagggaaaaagagggcatgttccacatagttattttccattttagggactggctataacatttttattaaacttataaccacatcagcagcatttatttagaataattctgcctcacatgtttcacagtttatctttctgacatggctcatctattcttgagtttattttgatgcatctattggttggctggaatatgtctttgaataatgctttatataagatatgcatggatgccactttttctgatgccttatatatctgagaaaccctttgtgggtttctttttttctttacatatgaccaacaacttggttttgtgcaggattactgggctccaatattatctcttcaaactctaaatacattgcttcacggtctttgttgtcctttgacaaagtcataggccagtctggtttctggtcttttaatagtaatttttgccccaagtaattgggggttgtttctttaacttggaggttcaaaaatttcatctagatatgctttaggcattgatctcactgttaaaaccgcagggccctcaggtaatattttcattacaagattcttggctgttcctcagcactagttcaaattaaacatgttttatgctttcccacctctgggcgtttgtgacgctggaccttctacctccttctcatctgttgacatgtactttccttcaagattcacctcaactgctgcaccctgaatcaacatttccttttgatttattcctccttggactcttttgacaatttataactattttttcagcaactgccttactttagttttgttttctggttattatccttatgccagttggcgctctcctccagggaaaagacaacagcttcgttgtctctactgtttggcaatttccatgccagggaaattgaaggtgctcaactcgagtgacaaaatttataaaaaaaaaaaatttaaaaaactttaaaaataggaagccctctcccagatcaataacacataggggaacatttccccgaagcccccagcatgggaaaattcctttgatacatgtttacaaagataaagtaatgcttataatttgatgagatgcaaacaacctgtgcttatgcttcactccaattgctgagaaataacaaacctccggcacttatttttccttaagaaattgaatgttgaaaattcagagcttttaaaagtatcccagcctacttttgtttgaatttccaagttcccacagcagcatatatttattttgtttccttctccaatttactctttttttgttcacccatcagtatctgagtgcagtgcacctctcaaaatgaaggattgtacttctaaaagcaaatgcatttttctttgatcctgaaaaactcagctctccattgcagtgataatgacggaaccctatttagtgctgtttgtttttcatcatttcaacagccttcaacttgaaacatgataagaacagcaaaactgataaaccacccttatttttatctgttttctgtcagagtagttgccaagcactgagacagatttttctaaatatctttttaaaaaaggagtgcataaccctgtgcttcaggctgaggccagcacaatttagtacatttattatgttatgttacagaaaattccagcaaaaagagaacggcaagtttaaatggagtctagcattatgttggtctctgttatccctaaagtaaaatcaactttttattttccggtgaggacaactattccactaatgagaatcagaacacaaactctatatttgtttgacttcagcagcaaaccaaattattgctaaactttagtggttttttttttttttttaaatttcagtaagtgatagacgttccagtgtttacaagctgaaagactatgcaatccattaaacaagtatgcctactaggaaattgttattacttcaatattatcattcatccagttacaacatttgttttcaatttctaaaaacatgattgagttagtcccacgagttgaaacgggcttaatgtcccgtgatgtgatacagtagtaatgtgcaaaaagaaaaaattaagaggcatacagggactgttttatgctaaagtcattctggagatgtgtttaaaagttggcttttctgattaatgtggtggagttttaatgctgaccctttcctggtacttcactgatctggcaaagaaagacaatagaattaggatatttcacacatcatttagttgggtgccaagacagtaaaatatggactaaaaaaatcattgtgagcattttgtacatatgtcagcttataatttgattggatatagttcacctatcataatggtatatgaactacaagtatttgacatctatgagaaaagattgagttttacgactcaggtttataagattaattaggtgactcttttaataaaactgtgatgtgactctgatgaggctgccattgtgaaaaccttctttcattctttgataaaaatcaacatttaactttataagcagatactgggcatctctacgatatttggggttcactacaaaaaacagacccacagataggttagtttcttctagcatctcttttacctaggataactagagaaattatattaatttctttgacaaaatattcagctgtctaacttttatatattacaaaattaaaatgaaaaaaaattgaacaaattgtcattgatacgcagtcaaatttgtccatgctattcaacatacactatatccctatactaattaatatatagtagttatagcagttttaaggggtagttttgcaatcttcattaaaatttcaaatgcacatactctttgacccagcacctccaactctagaaatctagcacggaggtctatctacacatatgcacaaagagagtagaaagagattttattgtagcattgttgatgtagcaagttaacttagtaaaacaatcatggctagggaactagttgaataaactatggtatatcaataccatggatgtgatgtagcagttaaaaagaatgaagcgaatccatgtattgaccctctccaaaatagcatctaagacattgtcaagcccacttaaatatattgcagaacaatatatataacataacaccacttacattgttttaaaagtccattcaggattacatatctctatttgtacacatgttaatgcacaaaacatggtctgaaaagatacacaaatcagaatagttctgagaaggatcggtaatggtggcagtacagataaactttcactttagttgaagtatttttttgtagcttttttttttaacaaggataacataataatctaataatggaattaagaagaaatataaagcaatgggtaaaaagttactataataaatatcataattacagttcaataaagagttgaggctccaaagacacagagagaaaagatggaacctaattaactctagctcaggaatactgccttgctcagtgatggactgtcagaagtctgggtgatgttggcagctcctgtgtagcccagacttagtcctgccatctggtgctggcttttaaagagtggatatcagaaagtaaggggatataggagtcattgtagagaggagactgcttggcaaagagtaaaaaaaaaaaaaaaaaaaaaaaaaaaaaatctagagttagggagatgacccagagccatgatcactccagaaaggtaaaatgtagtacacttgagtggtgtcttctgaggataaaggaagttcacatttcatcaacagagaaggggcagaaactaagcacaaagttcccaaactgcctgataaggatccttgtatagaatactgaaagatcagggatgagctaccaggttatatccctttgggtgttttatttttccatgctgggtgaaaaggtaatttcctaaaaaaccaaaactccgtctcgagaaagaaaaaaaaaatccacatgggcctaatctgattttttttttttcaaatatgtagactcaaactaaaatcttccaaagacttctgcatgatcttggctttgtcccaatattatctgctgaacacactccctattattcttaaaatgtgattctcatgataaattagaaggctaatgtgttcgcgtaaagaacacctgaatatgccgcagcaggtctcattttacagatggatagaacaggccattaggcatggatagagcagactcagctggctctgataattggtagttgacttgaatctgaatagaggtcaatcaaatgatgctacggaagtttagagaactatatcattcacacagagattttccttgtaaaccataccagctcactccgtattctaaattctgtttagagtgatacaaaattgcccactttttgaaagaggagacaaccatttaccaggcctgccaagtaaagctgcgtgggttgtatactgctcaacccaaaggaagttacaatcacatggactacgtacaacgtgtgcaacctgctcagtccacacagcaggcttgtcattagaaatataaatgctattactcctgattcaggttaagcaagattcaaagagaggagccactggaaggtacttggagggcatttgaactttagcaactttgattagtttgtaaggcatatcattttcccacacagacaagattttactatgtacacaaatgccaggagttttttggtttttctttttaaaaaatgctattattgcccaggcatggtggctcatgcctgtaatcccagcgctttgggaggctgaggcggacggatcacgaagttaagagattgagaccatcctggccaacatggtgaaaccccgtctctactaaaactacaaaaattagctgggcgtggtggcacatgcctgcagtcccagctactagggaggctgagacaggagaatcgcttgaacccagaaggtggaggctgcagtgagccgagatcacaccactgcactccagcctggcgacagaacaagactccgtctcaaaaaataaataaataaaagaaaaaggctattatcgttatttaaatggtattgtccaatagtttggaaggctctaaatctgtggttccttgtttcattttgtccttttgtttgactcctgcaagcttttataaggcagtgagaatctcactctcaatacaatcagtttatgattgtttgcaacaccctagcaacctccagcaggcctttgtgttggttttgtagaggcctgttatggcttctgatccggcttcttaaactcatgggtttctgaattatgaatcagtatgcctatttatttatttatttatgaatgtatgaatgaatgaatgaatgaatgagatggagtctcactctgctgcccaggaggctggagtgtgctggtgtgatctcggctcatcgtaaactccgtttcctgggttcaagtgattctcctgcctcagcctcctgagtagctgggattactggcacacgccactacacccggctcattttccttatatttagtagagatggggtttcactatgttggccaggctggtctcgaactcctgacttcaggtgatctgcccgcctcagccccccaaagtggtgggattacaggcatgagccactgcacccagccagtactgcccattgcctcttctaacccttttgcctactcacattcgtatacatatacaaatttgagactccttctcaaaaaaaaatatatgtatatatgtatatatgtatatatgtatatatgtgtatatatgtatatatgtatatatgtgtatatatgtatatatgtatatatgtgtatatatgtatatatatgtgtgtgtacatatatatatatatatatatatatatgtttttttttttttgagaaggagtctcactctgttgccaggctggagtgcagtggtgcgatctcagctcactgcaacctccacctcccaggttcaagcaatcatattttttaaatatgtcttttatttattacataataaattgaaatttttaataccttatttatatttatccaaaacttagaagtttaagatcattgctaagtactccttattctttttttcactttttcataacttttctattgtaattataaggtgctagaatccatagttcatcaatgcaaaatgtaaaatgggattcacttccacaaagtcaaacacaagaagtaacagcaaaataaacagaaaaactttatgtaacacattcatccaatgaaataactatctaccatgactggtaatggttgtcctacaagatggacgaaaatttcatgaaataacaccaatacgaaaaatttaaataatagtaatgtttctacttttcaattataaatggctatccacataactgaattttcttctaatctgcttcaagacttaaagaattttctttttctttcctgtactaatcattgaacctcagtttctaataaattttggagcatctgggcctttgaactccttgaataaaggtactgttaaaatactaaggttttcctgtttgttggttggtttgactcaagtagttgcatatatttacaggcttaagaatttgatgaagatcacgtggctgtcactagggagctaagacttgggtccacgtctccccttccaccagactctcacttccaccaatgggagttttactatgaacagatgacagttttccttggagctccccagatggacccaaggtccacgattctatcaatcaatttaggctgtaagaatgttggtccaagagagaaatgctgttcctgtaattgtcttttattcatgaaacattagctctcccactctactgcactactgaaaaataaatgaattaagtggtttttaaagcactgccaaaataggtctttgtgaacctggtgatatagtttggatatgtgtaccctccaaatctcatgttgagatatgatcctcaatggtggaagtggagcctggtgggaagtgtttggagcatgggaggtggatcgttcatgaaggcttggtgccctcacggtggtaatgagggatattgagtttacatgagaactgattgtttaaaatagtgcggcacctctcctgtctctctcttgctcccttttgccatctgatacactggctccccttttgccttccaccaaacttcctggggccctcaacagaagcaaatgccagtatcacgcttgctgtactgcctgccagaacaggttgtaggccaaataaacctcttttcttcagactaacatacctggttatgtatcagctagttacatttatgtcagctctatctcttttagaatattttggtctatggttgaccttttagttcgagtggtatgcatacatactgacgaataaataagagctagtattaagtgtatttagaataacctactggtcatgtttaaggatgacagtagagaggacagggtttgcctctcatgcagaataatactagaagatgggaaacagttaagagactgtgacaccaaagagctgaaggttaatattcaataattcaactcaatggatgcaaaatgggagattcctcttctatgtatcaatcgccatgcagtgtaccccaggcatatatacattatatgttcaagtagtctgaacatgctgctagggactgtgagagcacggagacctgggctctgtcccagaggttcttattcagtaagtctggggtgggaccaaagattgtgcatttccaacaagttctaaagccatgctgatatggctggtcgctgggccacactttgggtaatgaggatacaggcacattgctaacatttttatatgtaaatacagacaaaaaggtgcacagaatacactcataataatgtacatatgtgtgtgtttacatacatacacataaatttaaaaaaatcaaaatctctcattcataaggattttttgtccttagcaatgtaaagttcaatggaaaggagagaccgcaaagggctgctttcaaaaacgcaaagtttgcttttcattttttttaagaccaaatactttactatctccagatacctgaaaatatatggaattatcttgtaataaaactcagatgcccaaagcccaccttttgagttttctttgcaagaaacaaccccaaatgcgagcaaatcagataccatgtaataagacctaaaagtatttttccaaagacagaaagaaaaatatctaagcaatagaacccagattggaaagacaccaaacaaagataacagaactatttttaagcctcattttatgaccaaggggcacagcaaaatagtttgaaatagaaagttttcatgctgattacatgaaatcaaaatacacactgttcaaaggcagccaacattattattttttaaatgcagtctagttcatgcaataagtttcagtgttctttcagtctgggaacatttcaaaatacattgcaggtacagctgggaaaactcagtgatacccctgtccagatctcagctattaggttataaaaatattttcacatttcctgcagatgtctagattcctttctttggtagtaattttaattcagacctcattattgacagctgtttgttctgatagaacttaattgctcttctaccagactcagctgcaggcaggctgatttcctttccttatagagtatattacatataaacacaggcaggaaaaaaataaccaattaactaaatacgtgtgcataaaatgattcattgagagctctgatcaagtaatgtatccaactgcaacataggtcaaaggaaattacagcacttatagtttacagtattaaatataattatatagaaatactcaaaagcactaaaatatatagatgatgagtggcagcatctgaaaatctacttttatcaaagaaatttataaaattactatatttgagtaactggaagggtatttattctgctgacggattaactcatggatatctattttacataagctatacgctacaaagaacctgagatgccttccataactgacaaagtcatgaggaacccagcatgctgtgggatcacactgcaatgccaacaattcttcttcgaagggcagagtttctggggacacaccaactcttttcctcattctccagtcactgctgtggatgagctgcttttcctaactttaccagaaaatgaatacaaattctttgaagttaaagctattccctctgtttgaagacaatgcctcattttagcagctcaccaagagatgcaggaatagcttggcaattttcattctatcaaatgccttggcagcctcactcatggagtctaggcctatttggagaccccaagctgccttccttactggactggaacccctgaagagggataaaccgagggctgaattcatcaaagaacatataagcagcaaatatactgcatttgagacaagcaatagttccttttattggctctgtctgttttggaaatggagagaatgtggtgagcagggaagaacaaactgctccttagtaaggaacccactcaaggaaaatgaagtttttttcttaatactagggacgctatatggtgcatcccttttcggggccaataaatgcttctctttgcagacttaatctacctcatatagggaggaagatattgggaataggatgcttattaccctgataattctcagggatgcagcatacatttccattaatactaggcataatgctaattacaatgcaagccccacactcaacatttacaaaccctgacaaaatgaatgtaagtatcctacagggtttggtatccacaaaatctggtcaatagcctactcccagtccctccctttcccctaagtaacaaaggaaaccaatacttcttggtctttgagagtaattctactaagtcccgtattttttagtctatacatacagatcattatacccttcagattcttgcatggtatgactcctggcatcgttttggattgtgacacttctactctaatgctcactttatttagtgtctgtttcacacatggcatagttctaagggaggatgcaatgtgacctcatagacaccatctccaaccacgtatctctaacggttgaaagttacagcctggggaagaaattcagttttggctcatggaattaaagacttactacactttaaaattccccccatcatttttttttttcttgaaggttcacttcttactggttaaaatagtttaaacataatttaaagtcctgactgagttgatgatactgactattttgttttcaattaagcataacagagcaaatggtctttgatgtgatgtactcattttatgaaagaaccaggctggcaaacaaaaattttatggaatttagagatactaactctggctcttccacctgcagcttgtatcttaaatacatcatttatttattcttccagagcctctgttttctcacctgtaaaatgtaaacctatttcctaagttttctatgatactgtcagcaaaatacattttaaataatagcttcttgatcaatgttaatttcagtactcttttttctatgaattgaggacctagaattgaatattttaattcagttagcctaaccacagagtagatatgcaaccttcctattcttgcatagtttattagacttctactaataaattttatgaaaccaatatttaactttattttctggtttaaatcctctcaggaaaaaaaaatgtaatataaaattgaatcagatttcttgtaatcccagcactttgggaggccgaggcgggcggatcacgaggtcaggagatcgagaccatcctggctaacacggtgaaaccccgtctctactaaaaatacaaaaaaattagccgggcgtggtggcgggcgcctgtagtcccagctactcgggaggctgaggcaggagaatggcgtgaacctgggaggcggagcttgcagtgagccgagattgcaccactgcactcccacctgggccacagagcgagactccgtctcaaaaaaaaaaaaaaacaaaaaaaaaaaaaaacaaaaaaaaattgaatcagattttagattcggcagggatcttagagatctggtggttctcaaagtgcggccccatgaccagcagcatcagcagcatgtaggaaactgttagaaatgcaatttttcaggccccaccccaacctagagaatcagaaactcaaggggtggggtcaagcagtttgaattttattatttcattatttttgagactgagcctcgctctgttgcccaggctggagtgcagtggtacaatctcagctcactgcaacttccacctcccaggttcaagcaattctcttgcttcaggctcccgagtagctggaattacagacatatgccagcaaatttataaaataattataaattttatagttttagtagagacagggtttcactgtattgcccaggctggtctggaattcctggtctcaagtactccacctgcctcagcctcccaaagtgccaggattataggcgtgagccaccccacccggccagctatttgaatttttaaaagcccctaggtgattctggtgcttgctaaagtttctgagccacccatcaagccattctcttgcattttacaggtggagagactcaggaacagagactaaaataaaatctctgtatttcagttgcattgctttgtttgtgtcaaagttctgttttcctccccttatctcaagtaccacttagtgtttgttccatcatttcttcctttccttaggcatatggctatcaatatgcatggtcttatctgacttccatttaaccaatttaactcaagctttccttttcctccaaaaagctcctcccattgcttactgcactaggtcagctcaatgtttgttaggaggctactctccaggttgtctgtggctctagaatgtttgtggtgtcatcatgtttattccaaaaataatcagtcatttcatttaagtaatgtaattcttagataaaatgacgagatatagttacaaaataaatgagttgtttctgtaaaaaccaagttaattactttggaaagatagacgtaaaagtaatttgtgtcccgtcatagccaataaagtaccattgaattaggtaagggtgacacaactgcaggtaaatggaaaaatatttataaacatctagatggattctaaagttgcttaactttagaaacaaactactgtttgctgttgatattaaaaacactaaatctgctaatcattggtcatactcaaataagagttcttagtcccaaattttaaaaactggtgaatctaatatacagttatgcatttgaggttaatgtcaactgtatacatacattttagggttctttgcttcacttgaggttttgtctaaatgatcaagtctaaactgaacatatagatcaaggttccttctgaatggtcttgattgctttagatctcttcatatatgatgattaagctttttgaaggagataccatactctataacccacagttttgcacagtgaagttgtaataaatatttactggttatatttatatatacattttattgaatgttgctaattgattagccaattacacttagtagttcatcatctcgttttattactgtgagccaaattatccaggctatgaaacatttcttttatgatagcacttcctggagtccttagagaaattccaaggggggacaaatagttctataaatttcctcttgaaggctcacaatgcattaggctgagaaaccctgctgtaaagaaaccagttaaacttacttttacccatacttatttgactacagaaattcacccccctgcatcaattaataatccatgattcaatgtgcacatatattgatgaggtatcccaaattttctaagtgattttcattcttatgttcaaacctttttttctgtttctgtagattttctcatacttcttataacccagaataggtgtgaattatgtatgccaattatgaatgcgtcagattaaatggtcaacatacggatttgtaaaacttagattggtaaaactgctatttttttctattttcttctttcttctcaatgaagtagcagaacattttaaatctagctctgctttcacagattaaaagaaaaattttagcaggggaatgtgaaacttagaatgtcaaataacaggcagtggtggaggctttgatgaactgagcctaattaaaagtaaaggtgctgagtgaaaattttaaaagactgcaagccaaatgttgctaaggacaatttggggtacaagctttccaaagagggaggtggttttaatactctgtaatcattttgaaacttcatgctataaaagacttcagatgtagaaaagcagtctaggtatcagattataacagcataggacacctagtctaggagcactcaacctggagtcgagaaagcagtaataaatgccctttacactacctctgtccatggaaattgaatatttacctgagataaggttgcccaggctattaaaatctcagatgttgaatggcagttatgtaatgagtttctttgaaaaacagaaaatgaattgccatttaacaaacactgcctggaatgttgataattgaagctgtgtgatgcgtgcttgggggttcattatacattctctccactttggggtatgtttgaaaatgaccaaactaaaaaaaattctgaaaaaacagcctcctttgttcccgcttaaggtaaagcactttctaagtgtacagaagtcccccacagggcagaaataacaaagaggatcgtgttcagacccactcaccttcttccaatagctaggactggactattggtttcttaagccatagccaaactgtgatatggtgaagctttagcagaaaaccatgtgacttgatgagattgcccatgcagaaatgcaggcaaagaattcagcaagaggtatgtagaccaccttgggaatttgtacctttgtacagtatgcaggccacaaagcttcactctaaaaatgacttacatgtagaattattatctcagattttaaagatgtgtttattcctaagcctttagaaaatataaacacaacaacaaaggcatacatacctatctcttgtaactggactacattcacagagctccttactaaattctggaagaggttttgctaagcttgtagctttactattgtaccctacaaaccaataagtttgagtttaattgaaccaagatagcaaatggatttcagactatagtacctcagagaaaatagtctgaaaccaggtcaatcattttcagacacacgaaagagggatgaaatattaaccatagattgtagaggaggatttttgtggtttgtaacatgattggttatggtttttcaaatctaagtagcaagcatgagtccagactgagaaagcctctgcccaattgattagaattggagttggttcaggttgacaaagtgagagtttaggatgtgaagaatgactgaccacctataaaccaaaatttggactgaagttgtttcttcaaagaaacagatttctagaaaaccaatcaccatcatcataatcatcatcagagtaaacaagcatttaatctatctgattttatccagttttcctctgagaagatgccattggcaaatgaccagactgttctctacctttctacagagctataacttcagtcaagtgagtgacttgcacaagatcatacagttttatccaatatctcttatttttctacatttctacaattatcatttttttgatcctgaaagctaagtatgtagtgaaagtcatggaattc

SEQ ID NO: 83 - DNA, 89728 bp, Homo sapiens
atatcaaactgcacaccaagaagcatggaaaaacaagcctttatatagtactccctccaatgtgatagatcagccaagtggcatgaaagttacacctgccagtcaatctatactttcctagtgagcagagaccaccagctcatatacttccagatagctctggtgtttatggtatataatcctcttaaatgcatgtttgctgagacacagtaatgactcacattgtatatatccccacactacactattcctgcatacagccagaagctgctttaaaatatttccccagtcatattcatatacaaagataaataaatttttcagtttttcaccaagttttaaatgcaatctcttgagtcccatggttttatcacagaaaggtacacttcagcttaagaagggaagaattaaccattcaacttctaacaataacagtacactgaagacctaattcaattggcacagtctgggaaatgttcaccaactacacacaattgagtgatagaatgcaaaatacttcatgctttcttagcagaacactaaaatctatcagagaatgcaccttgattttgtcaaactacagcaataaaagtaaagcagcaaaaaaaaaatatgttcgctcattctcaaaaactgagttcgaatttttttggagggagggtgtggttctttcacaagcagtttttaatcaaaagtaagattttgtttatttgtttcaaatgtgtcaaattgctatgaaaaacagaaacaaatattaagctagccattgtgtccccacgaaaatgcagcaggtcttaatactctcccagctgttctgacaaccactgtaggcagcccttcccctctgtagacttggctgcattgcactggggagtagcatgatgtccacttgaaactgtattatctggagcttgcttttaatgtaattacttcaaaacagagaaaagaattaaaaggcagggttttttgtttttgttttccatgagctgatcctttgaacagctactgagaggaggacagcttacctgaattagaaagaaaagctcaactgttaagtcacttaccctaattaaagatcaatacagatattattagacattcattctacccatctaatccagagttgtgatgttacttttcataatacctgtatacacttactgccaaatctgttttcctgcttttcctattgtctttttctctattatttcccttcaccccacttttatttctcttcacagaaatgcccctgcatgacacatagtaacaaaagtcacagtccctttgcaagaaggaagaagcttgaatttaagcagttcttttaaaaattcaatatccaaagaaatactttactgtaacagtgtcattgctactccttagacttgttattatgtttgtgaaagttaattatctgataagatacactgtggttactactgtcacaaaaaaatgcatgggtatgtttattaattcaaagtgttccaatgaaataaagtgtgttaactaaagaactgaacaattatttccccgtaattattactgcacatttaggcgtttcataactgttttttttttttctgaatgaaaatcactttatatttaaaactatcagcatttacagctttgtattgtaaaagaatatgctattttgtccatatttttatactaaaggcccaggttgaaaaatccaacaatttaaattgaagatttttttcccctgctgtagaaaagtgtcaacatttgagcaaatcattaaacatactagaacaagaacctacaactaaaatgctgattatgattcatttcaaatattttaagtgttaagtcaacattcaatgcaggataaaatgaaatggtttgttcagaaggaatagttagagatctgcttactattctttctatttctgttattttcctgggataatccataaaaatcttatgtgaaagggaaaaaaagagaagatagtttaaaaatgaaagccataatctgaatggaattcgtatggcttcatatcagaaagcccttataggtgtcactgcctcataaaattctagcaataaaattgaagccaaatactctcctttcacagaaactacctttttctcaatatctaaaaatttgttctaagacaattggaagagaaaatacatgcactcctctagccaatagatctgcaaacttctaggtgactcatttgataacaggagacaaaattgtacaacacactaaactctattatttctacatcccagtagtttccagtataatgaatgtcctgtgagttttctgcagacatctagcagaacataactgccccctcgagtgaatgctacaccacctggattcaacaatacatatcactttggccatccatgacctccgccttctcaaactgatgtacgactaaaaacttaatattttcacactagcacaagcattgtgtcttgtgtacatacattatctctaacaagacacaagcattgtggcttgtgtatgcacattatctataacaatgttatttaatataattatacacaaaaataaagggaatttggagggccagtttgaaacaaaaccagaaggccaggcgccatggctcacgcctataatcccaacactttaggaggctgaggcgggcagatgacctgaagtcaggagttcaagaccagcctggccaacatggcgaaaccccatctctactaaaaatacaaaaattagctgggcgttgtggtgggcgcctgtaatcccagctacttgggaggctgaggcaggagtatcgcttgaacacgggacgcagaagttgcagtgagccgagatcatgccattgcactccagcctgggcaacaagagcaaaacgtcgtctctaaataaataaataaaacaaaaccagaaaattcaattttttttccatcttgtttcttaaatccaaccagttcaacatatcctcatgtactggttaagcttccctaaaccaaaaatctgaaatccaaaatgtttcaaaatccaaaactttttgagcactgacatgacaccgaaagtgaaaaattccacatctaagtacttaacagaaacttcatttcatgcacaaacttatttaaaagattgcataaaattatctctgtgcaatgcatataagacatataaaatataaatgaattttatatgaaatttcacatacatgaaatataaatgaaaggtaaatataaaatataaatgaattttgtgtttagacttgggtcccatccccaagatatctcattatgtatatgcaaatattccaaaataaaaaaataaaataaaataaaaatccaaaatctgaaacacttttggtcccgatcatttcagataagaaatactcaacctgtatcataattaccctgattctacaggcaattaatgcagtttcagtaagaaaattaagaaaatagggagtctctctgagcctattctggcttgagaagttgcccagtaaaaaataataaaaataaaataaaaactaagaagaaataaaatatacagatcactaattagaaaataaactataaatcatggggttaagttggtcacttttaattttttgcaaaagtgaagatacccaatgaccactggctaccatgttgtgctagtgtaaaaatatatcaccctggaaagaaattccagtggtaactgactcttttagcaccattttactcaatgtaagcaacaccaagaacagtgtcatgctacctaaagaggtactaggtctgaagaaagccacatgctcatttattctttgtagtaaaatctattctttatcatcataattattcttctaacctaaaagaggctttaattagatgttcaaaaaatagatcaaattaggtgaatattcaatttgcaaactcagccaaactcgacaggtttcattctaattacatgcagatagatacatggagacacatatgttcaccacagttttccatgtgcttcctctttcaggcaactgcaagattaagccaaactgtatggcaaagcgttccagaaagtaccatcttacatagaataagataatttctgatttttaatcttaactgtaatactaagagactgcatcaaaacaaagactagacgatttacttgtttaaaatgtcaattatataaagagatggtgaaattactactagaagaaaaaatgcaggccgaaaacaataaaaatagtgaaaaatatttggaaaattgcaatgtatatgcactgtgttaagtgattcataactgtctttcaattaaaactcgaatctttactataatagaattccaagagggattttcttagtctcaaaattgtgtctacaatctgaaattgagaacaaaaagtgcaaagtattccaaaagttagagatagcttgcagtgagcaagccagaagcttgtgggaacaattacataccttgagctcagaccaaaatataccagagcagatcctgctacaagtacctcccctcagcctgtccaccccttccccagctgtcacaagaagaggatcaaagaggagcactgaacagctttgtggggagttcagcggagagagagaagactcaattctctctcctctctatgggaaaggggagggaggtactccttgccccaaagtgatgaggtttcaaaatcagcactcagaagattagggatgcatgtaggcagacagtggcctcttattccttggttggatgcacacagccccactctggtactgttactagagggtagcggggtgaatttcaaggagagcttccagagagctcaggaatatggcatcttatctgttttactccccctccactatggagaaaagaagtttcttaccatgtatctcctgaaggctggggtagacctgagcagagagactggcgctcacttctgctatagagatttctgagggtataagacccaatatgcagtccataccagaaagacagacagacagtggtgaggtgtaccagggagaaggatgtgggaaatcccatccctagagtttgggttgggggctggaggaagtccctagtattttccattctcccatataaaaagacaccaaggttagtggaaggaaataggctgctgtgctatccaagtcacctcaaggagaagtcgtggaaaccccaactcatgcaaatctggaagtttcaaagagagacaaggaccttttaggatacagtaaattagaagagtaagagtagagaaataggtttgtccaagaaccaagtgagtgataatccaggaaaagtaggctggagtcacaaggtgggtcacctggaatgccagttaaaagaagtcatagaggttatgaataacgtggaggttatgaataatgtagagcctgtgaaggtttgaagctagagagtgagcagtactgtaggaaggaggagtgggaagttaatcaaatatcaagcaagaactttgcaagtccctgtgaaatgatgtcctgctttctctctcctctcctacttgtgccaaagaagttcagattgctaaagagaaagattataggggtcggtgttttctgcctctttttttttttttaattcatcaagtaagacaagtgagtaaattatcaaaaatcactcagctcactaacagagggacagttcactctttgaacccatggttttcttctctaaccccttgacttgggcaggaggaaaaggcatcagaaaaagatctacttatttaacgaaaatccctaataagacacaactgtattaactttaggcattatgtggtacattagatatttagacttgttcgtcctatatatctgctattttgtatcctcttgacctatatctcccatttcctttccctcccctgacctgtagtaaccactgtttcattctgtatctctgtgtattacatccattacacagagaatgaaacagtggttactatagctatatcagcttgaatgtatggattatagtctacatgtaagtgagatcatgcaatattttgctttctgtgtctggctaataagtagattttacctgcttttgtcagctaaaatatgtgagatgacagatgttaatctgcttcacaacagtaaccactatgctatctatatgtttctatatatctataagtatcccatactttcgcgttctaaactttaaatatgcataataaaatttgttttttaaaaatctattcagttgacagaaatggatgtcatttacagtgttccaaaagaaaggatgacaaaaagagattcagtgccccaatagcaagaagacaataggtcacctgccaaagcactgaagaactaagactaggggtgtggatgaccactgggtatgtgaaatgctacagagaggcgacagagaatgagacccagtaaaagcacatttctttcagtagttagagaggatcactggtacatttgagagagcagctgagtttttccggaggaagacagattgaagggaagtaggtggtgaagaattaaggcaaaaatttcttgaaagtgtgaggacaaacacagcctgtgtgtgtggatgtggaggtggggggaggatgtttccttcacttaatactgtggcaatagagacattcttgtatattccatttctacctatacagtgtgcttggagagtatcagcttgaaaaaggaaagtgaagaatacaattaaacaaaataaagacaaaatagaaaataaatgtattctaaacgaataacccaaaatttgaacaacttaattttgcagaaaaatgatgcgatacttctcatttaattttttaaaaatatatgcaaggtatcatccctaaactaatattcactaaatgaatttaaaatacaactaaagtaaaatgagagtggaaggcatataaattagtaagtcttgaaaaggtgttttggaaaaggggaaaagtaacaatggtaggaaatatgtatcatgtaaattaaaagaagcaaaagggaatgaaagttcgcccaggatacagaacatattaaagatacttttaaagcttattgctgtaagtatacttttaaaacttattgctagaattttcctgaatccattttctaaactgtaaagcagtttagaaaaaaaagtccactttttaaaaatgtacctagccaaatattttatctgtaggaatcagagaaatgcctacactgaatacggaaatacattcacttccagtaacctaaaagggcacatttaaagaggcatagacctaaaaagaaatctccagaaattattttttacacacctattgcttgaagagactgctgcatcaaaagctgcaacttacgacttttagaaaacacgccgcgtgcctttcttgtggttccatatgaaagaactgtatctagaaaggaccctatttttatactttgcactatttgtcctgaatcctttgaaaactctcttggacaatttcaaagatattggagtaactaaatgttggaaaagatacattctttacatacatactcaaatattcatcaggaaaggtaaacatctcacgagtccataaacattcatgggtacaaaatgttttcattcacaagttttcattcaaactaaattaccagttaaggctattatctcctcatacatgtgttaaattatctatttgtgttgtaccatctttttggttgtttactgttcatgttcatgacaatttgaagtcaatctaacactaataaaacctttgatgtaaccttcttggtttaagttacctctagatcttcttaaatccatttcttcgctgagacgtgaaaataattttattagtacagaagctctctaattaaacagaatgagattcaagtagtttatgcaaatgggttttcatcatatgataccaaatgcaaattaaagggaaaagtcacctgagacagacattaattttccccaaaagaatttgacactacacatatctacaaaacatattgactaaaattttcatttcagaccttcaactttgtctaaatgtaatctttcgtgctttattagggttgggcaggatgttacagatattaatagtgacatgctagggttccttgtaacacacatttaactctaccttcttataattactcattaatttgctatttcacttcttaaaaatattaaaaagggtgtaaagttagaaattgaatatcctctaatgaacaaatctccagttattaaatactcttaggaaagcaccacttcacaaatagatgatgtcacatactgtccctgaaatagtattcctttcagatgaacagataaaaatggcaactgattatgaaatttttagttaaggacctaaatataatgtccctagttagcaaggaacatgtaacataccttcattttccaacatcttaatttttgtactctgtgtggggggggtgggtgggtatgtgggggtgtatttttagaggcctaaatcctctcaatctttctgtttcaattctgccaattaaaaacagtagacacagcaaataaatgtaactggaaaatttatatggaaaagaatcagaaacctcctatccatttcctatattaaaatgagcttatcaaacctgcaaaacttaggtatttcataaaacacttgattttttttctactaagatatccttacacatcttaccatagatatttcaagctaatttgtattagctgatttttttttttctctgagaatatcagatcatctctcaaagtatttttctctatgaaacacagcggctgtctccatttaaaggaaaacacacacatacgcacagctaaaggttaactgaaacgtaagtagaaattgcacaaaacaaaatttgaagcaagttatgacctctttctcatgttgtcacctattttccccatcctaagcttgagttggctccatctgcctaattataagcttaaaaccctctgggtggtgactgagtctatattctgcactgcacttaacacatttttcatgctctataaattattaataataacagtagtaatagcatatacttttcctactataaaagaaaatatgaacctcacaactgccacttatttacactctcttaagccttccagataacagacagctgggtaatggttactaagatgactttgcctcttccttctattccatttttaattctccttaatgtatctcatttatgtttttctctttctatatttttaatttatccctctaatttcttgacctcgtatatttattctcttattctgaatgcaaagcagcaccagtattttttaatttagctgctaaggaaaatatctctatttgtgtatgttcaattggcataacgagtgcactgaagtagtgtttctcaactttggtgctattgacattgggggctgcatgatttgttataagtgctattgacattggggctgtcctgtgccttgcaggatgttcagcagcacccctgacacccacccagtacatgccagtagcacatcctgccccctattctgacaaccaaaaacgtctccaaacgttaccaaatattccctgggaaacaacttccccaccaggtggagacccactgcaatatggtaaaactattcccttcactgtgtcacattgctggagctaagacggaataaagatgtgataaatatgaaatgggaataacaaaaaatcacatagacacacacacacatatacgcatccaaaattattttgaatgtgcaattcaagcatttaaaaagcctgaagtttggctcatgcctgtaatcccggcactttgcgaggccgaggcaggcagatcacaaagtcaagagcttgagaccatcctggccaacatggtgaaaccccgtctctactaaaaacacaaaaattagctgggcgtggtggcacacgcctgtagtcccaggcactcaggagactgaggcaggagaattgcttgaacccaggaggcggaggttgcagtgagccgggatcgcgccactgcactccagcctggtggcagagcaagacgctgtctcaaaaaaaaaaaaaaaaaaaaaaaaaaagcatgaagttaatacaagcaaaaataagtaaaattccaatactaaggattatttgatggctaaaaaattagttctgctactttacttatgaaagctaacctggaagagctctaagtaaggcactagctgtgatttaagaccagtatgttttaacatccaattaaaataaatccttctaacagcacttttataaaatcacttagcttgttaaaacatataaaatgtttggctcccctgggctagattatgattaaggtacattcagagaggaaaaaaatgcttctcatttcacaaggtcacagtccatttccaaatgagcttatacttcactattttccaaattgggttgttttttgtatgtgttttttgtttgtttggggtttttttgcttccttcactaaactagccaaggtcctcctacttctgagcattactgtaaatctagatactgtcaaatagcatttaatctccaatgaattttaaaagccttgtaaattacaaaagaaataaccagggtatatttttttttccttttaagttttctctcctgtggtcagtaaatacatgtcaacatccaccttctttattttaagcaccaatgcagatagcattaagtggatgtcgcatacacttgggacatatgggaagcctcatgagataatgtttacatgcttgagatccgcagttgattccacccgggtttgaaatctggctcccaacctttctcccctatgtgtctttgaggatgttgccctctctaagcctctagttcctcaagtgtgaggggtggaaatttttgtacctattttatggaattgctatgaaatggaaatacaaaggttttatcacatatcctgcagagtgagctgtataataaatgttgactattacagattcattaatcaatagatgagcttcaacgtaagtattgtctcacgcaaaaaccccactcctccccctcctaaatctatgtaatcctgtatttctttatgtcatacccccacctccaggtacacactacacacatatgcacacatacacacacacacacacacaaaaaaaaaaaaaaaaaaaaaaaaacctcacgcctggcaatcctattccctccatcacactcaatacctcaagttcctatccaagacatgatgaagccctgtgcctccttcaacatcatcaaaacattccagttactaagcttgtggacccatcatctcacgtcgccttcaacatcttagacagatcttatctccatcaccttgtctccacccctgccgtccccactctgattcagtctcttgccttctacaaccagggcaattttagaagcattccaacttatctatatttacagtagcatccctactctgatacactcttcatagtgaagtcagagtatgttttctaaagaacatatcccatcattacttccctctgtgacatactgcaatgtgctcctggtccctgaccttcgggatcaactccaaccctcagaatctaacaggtaagtctatttatgacctgagccccgtcgttctatcccattttgaccaatagtgagtgcctttcatacaaacctatacaataaccacagcaaactatctccaggtccctgaataagtgacattactcctaatacttttttgtatattaagactgttgcctggcatgtaaatctccatgcatttgtttgcctagctcactttctagacctcctttaagcatcaccttcttcatgaagcagtttcagaaccctctgaggctgagagatgctccttcatctgaattcccttcttacaactccctaagcccaccttaaggagcttaccctccattatagtagctttctcatctatcacacccaccaaaattcacagccaaacattagctcattttcatttttttttttttttttttttttagatggagttttgctgtgttgtccaggctgtggtgcagtggtgtgatctcggctcactacaacctccgccgcccaggttcaagcaattctcatgccccagcctcctgagtagctgggattacaggtgcctgccaccacatccacttgatttttgtgtgggtttctttttttgttttgattgtttgttttttgatggagtttcactcttgttgcccaggctggagtgcaatggcgcgatctcggctcaccgccaccactgcctcctgggttcaagcaattctcctgcctcagcctcccgagtagctgggattacaggcatgcgccaccatgcccagctaatttttgtatttttagtagagacagggtttctccattttggtcaagctggtctcgaactcctgacctcaggtgatccacccgccttggcctcccaaagggctgggactgcaggcgtgagccaccgtgcccggcccattgtcatctatattttgttgttgttaaaaaaacggagtgcttggcacacagtaggcacccaaaataagtctgtaaaaaagaatgcctgaatgaaatgaacgaataaagtgaatattaaggaaattaatcgtttcatttagttataaaaagccataatggacaaagacataatcaaacggcatttttaaatggcttgcatacctaagatagccataaaggatgttgcactttaataaaaaattaaagatctgaaacacagaactgattttcaggttccacttaataatttctaaactggaaatctcaacaatcaaaacatgggagccgtaaggatgcatgcacacatacatttatcacagcattattcacaatagcaaagacacggaatcaacctaaatgttcatcaacagtagacaggataaatacactgtggtatatatacatgaggaaatactacccagctatgaaaaagaatgagataatgtcctttgcagtaacacagatggagtgggaggccattatcccaagtgaactaacacgcaggaatggaaaaccaaacacctcaagttctcacttataaacgggagctaaacattgagtacacacaaacacaaagaaggaaacaagagacaacagggcctaattgagggtggagggtgaggagggtgaggatcaaacaactaccaatcaggtattatctgagtgatgaaataataagtacaccaaactcccgtggcacacaatttatctatatagaaccaatctgcacatgtacccctgaaactaaaataaaagttttaaaaaatgtgatagccagattattatcagaaaccagcaaggcataaagtggaacatcaagtaccactttaatagcaaaatgtctgatttccccatgacaatctgtagtactccctaaattattaacagacccaggcaccacaagcagcggggactcacttgggaagcgagcaacacatttatttagttctaagattgatgaatcagaggaaggggaaagcagcagcagttattttgatctgtggggggtcttggtgccttttgtatctcagcctctgctggtgttgaggctctttgtgggtgcaggcctgcaggctgcttgtgtctctctctcctgctatctctgctgacagcttctctgtgtgacagcttggaatcccggcagtgaagtgtgaaaataaaacacaggcaaaactttacatgggaatttaaaattggagttatatttttgaaagttttgaacgcattaaacatccagaaaactgcttccttgttagagcgcacagggaaggaggagtgaacaaggtcaaatccaattcagacatcatttcacacgaggctccacaccaccctcactgtccttacgaccccgggagtcctagattaaatgttctgagtcaagttaatgtcaactatttgaccttttcaaaaccacggttttccaaaagttaacatctaccacatcacacttatgttccttctgttacatggtttgctcttttaatagaagttttaaaaaaactttgtcataatctaaggagatgagagaatctatactctcttgtctcttcttgattcagtcttctctcccccagcccccttcactttcagggcattccagaattcaagtttaacgagggcaaaagacagtcctgccaaagtcaacaatcaatacttctcaataataaaggaaatacagtattttggcccatatttgctttctataggataagattccaaaagcgaagaggaggataattatcaactccaattccccaaaacctttgtagtataaatgtttctgaaaggcactgtgttttgcaatggtttgatagaacaaactcccttatgtataaaatgacatatttttggccacagatacataaaaacacagaacacatttatatccagtctaataacataaaattgatggcatggtttggaacctattctctggattaaaagtagggtccagtagtagaaagggtgatttaaacaacctaaaataaaatgctttggtaaagaataaaatgtttcatgcaaatatgcattaataatactgtgccaataatatcgagagcagttcatgtcacaatgcaaatcagaaaaacaatctcaggaatttctgagttaaacagatgaccctgttcgaagtacatagagggttgggatggaaaccgataagaaatggaaggtggtagtacaggaatagcaaccattagcctcaacagcctataaaaaggattccatctttagaggcagaaactagtcgcttcctactgaatttctggaatcctaaaatgatgcattctcatctagcatcatcccacaacttcaaagcagtttgttcattatcatgcaatttcagcaaatcacatcctcttgatacgatttctgatctggaaattcagatatttaaataactgttctccaaattcctatttctaaaactgcttcaaaattcctaaactttcccacagttatgagaaaaatgtgtgatccttgatggtcatcacttcatattcactgtgattatctttgctctctcagagaatgatgtcagcaaaagtttcctttcaccacttgcgggtatctatgaaactacaattttacacaggatgcactgtcagacagcatagaacgccttcaactcctgaggcaatgttgctttcaaattgctaaattatcttttaaaagattcaccaattatgttgcaggaaaaacacatgtggtttagaatataaatatttacaacagatactgagattcagaggtgaaagaatgaatagtgatgtgatgttttctcccaagagacatttgccatgactgagaccactgccaaagaaagctttgttctccattccctctgtgttcctgcctgctgagctcttcttccactagtcattacaactacttctttggatagcttatgactgttgagcaaatatggcatttgtgccttacaaagctttcaatttaacaaaaatttctcaaatgcacaaatgtactaattctaattaccaatatcttatatttcacactgcatgtctactagagaaaagatcaattggccagaaagcaaattaatctcattaaaatccttaatgtaatccagtacagtaacaaggagattaaatgtaatattgaaacatttcttataaatcatattttatatattagatactatgattcttttgtttctactgcataattacacatatatcattttgaataatttatattatctatttaaaatctatttaattaatcaagagaaataaaggaaagaatgaaattgaaaagaaaaatttatctaaaagccgtatgtaagaagcaaaagcgctaacactggaaaaccaatgttgaaaagaacccacagttttcaatgataccacctgttcctccttgaaagctaattaaaatacaccttaggaaacataattgcctacagctttaattacatctcttccaagaataaagggctaccactcccaggatatgttttctcactcagctactggtgtgtcttctctcgtgttgaatctctttctgacatcataagtgactgcccacctttccatatatgtgcaatcatgagattcaaagcctgtatcatttcagaacctagtaaattcaatagcaattttatatttatacctatctctacattgagtatatatacacacaaacataatgtacgtacatctatatactatatatgatattaaatatacacacacagctacaattatactacctagcaaaatacagatactatataaatacataaacacacatacacacataaatacatacaaatatgcctatacttctatatctatgtctttccattaccagaacaaattatgatatgcatctgttggcaaatacattgtttgacattcagaactaattttccactggaaacaatgtcccagactagcccatggcaggcttacaaatccaacatgtagtcgaatgattggcctcacgggactgatttgagtttcagggccctggaagaagatatgctgtgaaagcagcagcaacacaatggaggataggaaagggaagaggagaaagaacacattttcctatatttcctaggttcaaaaatttgaaacagtcactttttggtattcctcctctcccttccttcacctatctcctgactttgttagtgccctcaagtgtcctccacattctgcctgtggccctctaccaaggttacgtcattcccaatcacgcctcatgccaacacatccacagcttccctgatcaatcatccatagacgcagacactcagtgtagatgaactcttttagatgttagaaatcagtttttagttaatggtaaagtccgtataaccaaagcaaacacattttatttacatgtttgtttcttaaagaacatgcttactaatgcaaataagaaactgagagaactatagctagcgaagaaaaaaaaagaaagaaaaagagagggcatagatgcagtgggttacagttttacatattttggaacaggctagtttgaagcaacagtttaaccaagaagctgctagaacttgagataattctgttattcccagccttctctttttccactgagagaagcaccatgtctttaaaagcttttgtccctcaatctgtacctcctccccatctccatacacacacgtatctagactgcttaggagaagcttctccaaccaagatcaggttagcagcagaagaaagtggtggtgcaaagccgccagccctgaacgatgtgcatgcgtcatatagacaagttgcttttgtagagataccccactgcaaacattcttttaaagatgacctgaaaattcccatccttgaatataaattcatttctccactgtcattattgtttctagcaaactacttaatataaaaagcaactacagcaataagaattcagtgattgcccttccccacttaaaatacataatatctactgttttcattattacattcttggaaaccagtacattacttcagctctaaaaggtgctgaacaaccgactacggtaggagaagacaatggaaatctccaaaaagttctacaaacatttcccacaaaacatgcaaggattttttttaaacccttaaatatgaaaaatcacttcatagcccacatttatgaacatatgtacgtaaaaaattcaatgagacagcaaaatagcgatatagacacctttgtcattcagtacaagctaaccacacaatgtgcagaatgtatgtgactcatcaaaacataataaaaatgcattatgcattaggtaaacaacaaatagtgtttttgcacgagagaagtctaaataagaatgtaaatttatttattaaacctcttcaatgagacttcgactcctaccgggatatacccattcttagcatgacaaacaaaaactaacaacaggagttcccagggaggaagcctgaacttgggctttaaataattaacacctttcaaagaaaacataaatgtttggggggatacatatccaaattacaccaatatcacacgtacccccaaaatatgtactatgtcaataagaaataaattaaaaacccctgtggtacacaacatatacatttttgcaattaaaaagaaaactatatgaaattataaaaaacatttaaaaataattaacacccttttttcccttaatttatgcctatggcaatttgttgttagcagttaagccaaaatgttatcctagtgtagcaggtgatgtacaaagctctttcttaaaacattgaacagaacatcacatttaaggaaaattaaggaggctgaaatgggggaggtctgagtatattttcattaaatatcaaagatttagtaatactaattacatgttttcttcccactcagttaagtgtataaaacagatattcactattttagctcttctaatgtaggcctatcataggtttttgctgttcctttctgagttgttgtttatttttttgtaagcgagtttctgctgttgctattttgttttcagtatttgtttcaagcattcaagactatgacttgcaggtttcccaaaaaaagtgtctaaaggcttttaaacctgggttctagagagatgagttttaacaataactccaacagttaccttaatcactgccttaataggtccacatgattttccacatcttaacttttgtaagaggaatataaaaaaagagcagcaggcttggaagaaaaggtggatctggcttaagaaggcataccacttttgagtgccacacacaaagctgtattttctgcatgtgctgtggtgtctctctgaaggaattctcttcaaatctgactttgcattcatgatttgactgtcaggtttgaaagcaaaatttatgaaaacatagggagaatataagaccctaaaagttaagcttctttgaaaaatgttaattcataacttggataagcctctctctttcatggagacactcctttctcaaaaaaaaaaaaaaaagtgtatacataagtgagagagagagaaaaggaaattacagaggacatcagttgtttgcaaacagttcacttttttcaggctggttttaataagcctccaattcagctccaacctgactctcagaacccacctcctctatatgtcatcaaggaaaaggaggaagaaataaaatttaaaagtccttcttgccagtcctatggcaggtcatattttccaaagatgcacatatctcacgccataaggtctccttccactagcagtggggagtctattccctccatttgaatctgggcacagggttgtgacagcactggccatagagtatgctggaagtgatgctatgtgagttcccagctaagtcgcaaggagacacggcttctgccgactctccttctggcagtcttcattctgccttcttcccttttcttccccgaccagaaccaggagtcctgggctaagacgtaagggttccaactactccgaagctgccatgctagagagaactcatcaggagaccaaatacagacagaaagggaggtgtctgaggagtcctaactgtaccagcagcgaatgttcaagaggtcccaacatcaaccagtgggcttgtgagtaggtaaggtcagaagactccagctacccacccctccttagagtcttctcattgcagctaagatatggtggagcagcgaaaagtcatctctgctgcgccctatctgaattactaacctatagaaatctgtgatagtaacagatgtctttttataagctaccaacgttttgtgtcatgtattatacacatacagaagctgaaacactcccaatgtgattgccagcaaacccaattctctgcaaaataaaaacaagtattatgtcccaagaactatattttgtatatcatcacttctcctcacaatgattttgtaagccatctctattttacaaatgagcaatactgggctgggagaagctaataaggtgctcaatgtcacacagctgacaagtgaaccaagattggaacccaagtccctctgactgcaaaccccatgatactcctctttccttcaatgatatccctctttctttcccctacaagttcacactgcagaggaaatcatgtgactaaggtctcagttatagtactgggctcagtaaaactagcctcactcatttcttcctttccaactaacctacactgaatcctatcatttacagactaatacacaaattatagtaatttctatatatgttgaaaaataataaaagaatgagggagctatgttaagattgattaacaggaaactatttacaagaagacacctatttagaacaatattaagggtgcctgctgtgttttgattttaagggttacagattgcactttgacaaaagtgcttctacgaattataattatattcatttacttcccaatgaatattttcattcaaaggattttactgctctctgtgggcatatgattaatatgcatgtgctcaaacaatattcacaaacttcacaatcctagagagagaaaaaacagtgatcagctttccccagtccgagtaaattgctttgagtgaatttctgcacctgtaaagatgctcttctggggatgggctgtgtttgcatccggggctggatgtcaagatgcccttctgtcctgatatttttcaagggcaacagcattacattgttattccaatggacagagctcataaaaagacatccttatattctggagcctttaggagaaagcttttctttggcagtgaatgaaaacaaaggcaaaagatgaaaggaaccatctttcaaaggaaacaaaaaggcctctacaaagaagtgcataaatgtagaaagcagaaaaaaaaaaaaggtacattatatttggcgtgagagtagagacaaagcaaggcccaatggagcaatactctttctttacaaatactgtcagaattttggggaaaaaaaaatcatttttgaaggttccaggaacaaaaccaacagacgagagcttaaaatatacacagccacaatgtttccattttgttggagtttcagaagaactcctgtgggcaaacgctgcatgtaaaacagactgggtgtgatgtaactatatcaaggcaacaaacacatcaggaacagttggaaaccagccaatactttggttttatataatgtccatcaactggttgggctgattttttaccataaatggcctgttttaaaactgactgaacagtggacttgaataaatagtgtaccaaactaacaccatagagaaatatacagaatcaaaggtgttcaagaatgtcaagcaacagcacagccacagaagaggtacaggccgatattaataaaccaaatctaatcacattttcattttccgactgaaatctttcccaaagcagtacctttacatacagtgctttttgttaaaaataaataaataaaaataaaatgccaaacgagcactaggctcctctttattatgtctttaaaaataaaagactcaagccagattggacagttttctttgaaattctagtttcagctgctttcagcggctcattttgagaaacatctgtccagtctggctcttggggagatgttcaaagacaagtgttctcatctgaatgctaagggactctcctaagggagtcaacagtcctctgaaagcaagcagaaactatcaaaacatctataacccttgaacttctttatcaagttcagtgcacagcgtacaatatgactcaatttcatctttagtaaaaaataaagtttgtctgcttcactgccacctttaagacatcatgttgttttcatattaaaaacttaaaatattcagtgaccaattaatttggaggcaaaattggccaagtataaagttatgcaggggagaattcagatttgaacacagctaacttggaatctgagttcatgtacaacatatgtatatacaaacccacatgttgcatttgtgaatgtaggcacagagtgaaaattctccatgtttaggtccacaacacagagccatgtcacgaagaattaacacatgttctaattctcaccagaagtgatccaaataggttaatgaacacctcctacatttcagatataataatatacattgtcacaacaatttcataaagtaggtaatagctccattttagaaataagtgaaggggggtcaaacaagccaaaaatgtgtccatgttcacatagttgcaactggcaaagctaggatcggaaccagagttattttgactaagaggtccagaaacttggctctaccaagccaccatccaagtagaaggttaccaaataccaaaatgaggaaatggtaaaatattatccatgagtcactgaaactacataataaaaaggaagccaaaataagttttgacgcatttaaagctaactctctaaggcatgggttaaaagttgaaagctagctatcagaagtttaattttatattctctcaagtaagagaaccaaacaaaagtagatcaaccagaccaaacttttaaaacactttaacttctctatgaagctaatgtgtaagatatggtatttcccccgggggagaagagcctgtgtaacattgcttttcactctcatgattgaaagaaaaatcaattaaaattatcctgggagacctttcataccattccaaagagccaagaaaatgctggatacattctgaatgcagcaaacactagactctcctaaaaaatattccacatatattgtttgctaaatcaaattcagtccttagattttacaggtttaagagaatctctggaatacatggcagaaatcagaaaaaaaaacaagcttatcctacatttggtttcaaagcgctttctttcaagatctcccaatttttctatgttaaaatttgtgatggcttctctcaaaactctgccagaaatttatgaggaatgaaaaaactcttctaacagattcagaaataaaactatggcattttcaaaggaaaaccaatatgaatgccttttaaataaagtttggtaaggacaacacaaaccgtatgttccaggtatgtgatgtgaaccacatggtctgtgaggcttcttgcacttgatatgctcctcctaaggtgccaacatcaacaaacaacaatgtgtactgtgactgaagttacagccaaggtcggatggaagtgtgggctctgttagccttgatctaattttttaatgtcaagcaagaaaactgacattttggggtacaatattgctatccaaagcaaatatgtggaatggaaaaaaggcaaatattaaattctgaagtaaacaaaataagaggtccttaggtaaaataagagtttttttttttttctcaactagtctccttttctcagagtaagtttcacattttatatactactcatattccctgagaactttacgtacatcagtgtctacatttggagatgatgaggttatttgatttaaaattgagaggccttggttcaaatctttgtctttgataatctatatgtataatgtcccaaataatcagaaaaataaacaattgagttatatcacttttacagttttttgaaattctgaatgcctacaaaattattctttattacaataaaaagttcgctatataatgacaatatgagagttatgtggcttaaaacaatttttatttgcataaatagtcatcctagtccacttacttggcgagtgatcagtaatttacaatgctgaataaatgtatcgttttcataagggacagatgtatttttatttttccttcttatccttctcatttcccttatcccattattctttcagtacataagatcaaatgatgaatacactgagttatccagatgtggttcaaaaaggaaaaatatagccaggcgtggtggctgacgcctgtaatcccagcgctttgggaggccaaggcgggcggatcacaagttcaggagatcgagactatcctagctaacatggtgaaaccccgtctctactaaaaataccaaaattagccgggcgtggtggtgggcgcctgtagtcccagctactcaggaggctgagggaggagaatggcatgaacccaggaggcagagcttgcagtgagccgagatcgcaccactgcgctccagcctgggcgatagagcgagactctgtctcaaaaaaaaaaaaaaagaaaaaaatatatataagatggtatctggatagcaataagttataaaaaaagaaagttatgtaagaagaaaaacatttagtaaacacgtattcttcaggtttcttattcataacacacaggccataataacccttgcaatggatacattctttttgtagaacaccaagctatccatccatagtcaaatgaggttataggagatttaccaaaaaatatacatcaaactacattcagtctcaattttctcatccatgaaaaacgaatggttttatccaaataatctctaaagtcccttgcaggcctatgactttatcactctaaacatctatgcctgtattcatatcattagtaccatcaacacacatgaatgcatttgaagaatgttctaaattttataaatcagggcatgagaaactaatacaggggcaaaaaagaggctcttcaaaattatggattagaagcaggatggattcattaatgtttttaatttcactcctcctgagaaatggagatgtctaaatcaggctgggcaatcactaaagtgactctgagaatcatccttacaaaaaaactttcttgttaaaatacagcaatatgattccacctctaattgataccaatatcattattaaaaaataaaaataaaaaataaactgtgtggatagaaagatgaaaacaaaatcagagtaagagtatatgactacagagaagggaatattttccctctgtactaattagttcatttcttgctacctgaagacttactgggttaatctgtggcaccacagtgtagtagtgtttttacactgctgatgaagacacacccaagactgggaagaaaaagaggtttaactggacttataattccacatggctgggaaggcctcagaatcatggtaggaggtgaaatgcacttcttacatggtggcggtaaaagaaaataaggaagaggcaaaagtgggaatccctgataataccgtcagatctcgtaatacgtattcactaccatgagaatagtatggggaaaccacccccatgattcaaattatctcccattgggtccctccctcacacatgggaattataggagtacaattcaagatgagatttgggtggggacacagccaaaccatatcacacaggatgtaatatcctatttggttcatctcttctttagaatattactgtttttctacactttgagtgaagagggaatacttatttggatagaatatttaaaatttgggccaggcacagtggttcatgcctgtaatcccagcactttggaaggcaaaggcttgtggatcaactgaggttaggagttcaagaccagcctagccaacatgatgaaactcccatctctactaaaaataaaaaattagctgggcacagtggcatgtgcctgtagtcccagctactcaggatgctgaggcaggagaattgcttaagcccaggagggggaggttgcagtaagccaagattgtaccactacacttcagcctaggagttacagcgagactccatcttaaaaaaaaaaaaaaaagaaaaattaaaaaaattcctctcctaacaattctaactccttctgcaacaaagtcacaaaggtaggatattttttcacatatatgactttacataattttcttctttaaaatatttagatttggccgggtgcggaggcttgtgtctgcagtcccagcactttgggaggtcgaggcgggcagatcacaaggtcaggacatggagaccatcctggataacgcagtgaaaagctgtctctactaaaaatataaaaaattagccgggcatggtggtgggtgcctgtagtcccagctacttgggaggctgaggcaggagaacggcatgaaccaccaggagggagagcttgcactgagccaagattgcaccactgcactccagtctgggcgacagagcaagactccgtctcaaaaaaaaaaaaaaaattagatttaatcatatggtcagtaatttatccataggggctaattttattcaagagaacacaatatgtttctcataaaatggagcaaaatgcccaaaacgatgttaaaattaagaaagaagatagtaggtaactgacagaggggggagaatgaaaaacaaaaaatgtagagaaaagacataaaaaatattaatttcacaatagtgaaatctactcttagtgaaaactaagaaaactcttttagcaacttaaaaatatacaggacattacttaatttcaattttcaaaatatgccaaaggactttgaatattcaagtacctagacctcccttttaacagacaattttaatcttgaatattaagcagacttaataattaagtggaaaaatggatttgactggggcatttctgtcttttcctccatcaagggaggtattagtaaatttcacaaaagtaagcctctgagaacatgtgaaagaaaaaattatctttctctcctaagagttcagaatggaaaacaatttgtaaactaagaatgagaagaaaggagttcaaaaaaataatgaaatggcttttgacaaaactattcctcgtggccacatccccgaatattccccatggccactgttctaaaatatgtactaactcatttgattcgagaaggacctaagggagaagagaaaaaaaaagaaatgacattttgattaaagaggtcgtttatccaaacatatgcgtatccactattggtttcttcctctccatcctactgtgctgcctccaagggaaacaatttctgaggagagtgtctacagtaccatgttcagaaggattctgaggctgttcttctctagagaaaaaaaaaaaaaaatagaagagtgctattatcaaatagtaatgtctgttttgaacaagggataaagagagtagcagcaacatacaaaggagaaaaaaaaaatgaacaaacctctcctggttggtcagaatctctataaatcttgaaatttcacaagtcttttgaaaccttcattacataagaattctattggatttgaaggtgatttgcctgaatatacttattggtacaaacagcattctgaattatcctttgaggttgtaaaatagtaaccagattccaagaggccaaacaatttttacctcagtacttgccagctttcttaaaatacgttggttatgacttcctttcacattttcaatgtgatgtgatcaaatcctcctgtaatctaaactaactttataccaaaagcaactttatgcaactttattttattccttcatattagtcccatctcacaccaagtatatactggcttgcatttcaacaacaaaagtcttgaaatagtgccattcaactcataatcatgttggtttttccttcatacctcctatttctatcattctattgcatactcactgggttcagaactgagggcatctacttcctggatttttactattctccctttggaaaattccgactctgatggtctctaaaattccttcttctctttttgatcatatttccttcttcagactctcaaacagctttgcattaatttataaataaaagattttcacttacatagattagtaataaaaaataatgaaaataaactaagtaaagagccagcaggtggattagagaaggctgactgctgttataaacagtctaccatctcagtagctgaacacaataacattaattgtttcattcatgtcacaatttaatgtgaattgtacggaggctttgctccatgtagacttaaagactcagtttcttccatctagtggttctatcatctcttcctggaatcttccattggacctcctgtcttcagaagccacctccattcttaaaacagcttagcctagaggtggcaccactcacttccacatcatttccaatcacatcccattaaccattgcctcatctttcctagctgagaatttgatttaatgatgtgctcttgaaaataaagaacgtattagtgaacactagcaatctctaccataggaaagctactttgatttccaagaaaatggcatattgaaattagccctatctgtctcaaaaagctgtcatgaaaatcaagtaagtcaggaacgtgaaatacttttaaaattgttaagtgctgtgtaatgatatggcacactgacctacgcctccttttgataccttcacttctatacttccacaaaagattattttccagacttttaagaacccccaaattcataaattttcaaaaagaaacacagtttttaacatgtgtcaagagttactgtcaacttaatccacaagacaatagaataaacctaaatcaaaacatcaatgtttggcagtaaactaaattcactactcagttttgggttccattcatcacaccaggcttaacgccagtgtgattcaaatccaagctccaaagattagcaaaatgtatacagactgcatgtcctgacactctgaggtatgttattaaaaacagtcaaaattgtaaatggtaactctatgattgttaggcctatgtggtattatgcgccgggagttttggggatacttgctcgtgtcctttgcacctgaaggttgaaggtaagtttcacagttttttccactgtctctcagtccaccaccacaactcccacctatacttttcaagcagctctgtaaatcctgtctacttcctgaaaccttactcagttgagtagtggaacacctcatcttcttgtctcctatggacttgaaagaaactcccacacgggatcattcactttcctctcatgacaaacatatccttcttctccatgttgacgtacgccaatgaaaataaactgggatatcagagaaaacatggaaagaaactgtatcctagcaactcatggccaaatataggcattaaggtgcttaaattattagcattcactatgttttttcatttccctaaagtcttattctttgcaagcactttatcagtacttagaaaataaggtggttaagcttcctccaggagctcatattctacgaggggtgtacatcaatcaactgtccatattcgatgtaagtgacagaagtctgagaaatcgctctctggttacgaggaaatgtagcgtgttaatcaaggtaagtgagctgtttctacagagcaagtcctgaaactgctttgcatacatttgcatgttcattgctctgagaagtcccatagtaaaagcaaagcaaagctgagaaaacaacacctacacacacaaaacacttccacaacaaaacaagccaacagaacaacttgcgttgcttgaatgtatttttgtagggtgacttttttctctatagacttgttaatagccctcagattttcctaaatgctagattgagaagcactgaaagatgcagatgttttaataatttaaaagtagataatttttactttacaaaagcattggaaatctcaaaagaaaagtctgtgtcattaatattcaaatgcttgtacgtttaagtcttcttgtaaataatcaggtaaatctctgaatatcttacctagatgtgaaaacatgatttaacaatggatagtgatgggatgtattttaaataagagaatatatttaaatgcagagctaataaatttttaaatctgaatgaaataaataattttctgggaattatataaattacttcttttgcctcaagaaggaatgggagatatgaatagaaaatagccatgggagagaaattttaaaagttgtaattttttttttcatgtttagcaaaaggaagcagaatccatagaggtatccaatttagagaagcctctaaccccaaaacaaatgcatactgataacattcatacaaacaacacttctacaataaaagtctgatggaaaacatgatttgtaatcggtcccactgaaatagaaatgttcagggatttggtattttccatagaaaagttaaatgtataagaaaaatatgtttaggtaggatctaaacatgctcaccagcagaagataaaaatgacaaacaacaatacattttattcaggattaaaaacacttgttttctgcatatgccaaggaaacttacttgcttgtgcttagacatttttacccacattcagaaaatgaagcaaaattcacaaattcaattcataatttctttttaagctgcatataataaatacctattattcatgggtgttggcaaatctgtatactacctatttttttttctatgtttagccttcggagctgcttaaatcttaaaatatgtaccttctttgttgttctctttcttactgtggagccccatggcttggaactgtaagcactgctacagtcccaaacaattctttacttgacccaacaaacatatccgtcaaaatattttgggctatagataacagaacatcctactaaaagtggtttaaaaaataaggacatcattctgtcacataaaacctgagggagggtgatttattcagctactcaatagcagctcaatcgctcagtcttttcccatccgtctgtcccctctgcctttctcattgtgctggtttgtctccttagactggttcctctcatgatccctacaggcctgcagcagctctaaacaccacatacagaggaaatattcaagaacagaaaaggaaacatctttgtcttggtgccaatcttgtgagtaaataaacccttctcaaaaactccccagtgtatttgctctaaattttcattcaccaggattgaatcacatggccatgtttaagtgcatcacttagcaggaaactgagaccacttcacttttttcaaccagtaagatttgccacttaggagccagccccacccccgcacccccacccactggcatacacagcaggttactatagaatgagagtagataaaatctgggtcaatgttataggcaagcaagaaggaagcgtctaacaggcaaacaacaatgtctgtcaatagtctgtttatatgcccagacactatcagataccaatttatattccaaggagtcattctcattggtaggtaagttgcataaatgattatatataatttttgagtaagtgataaacattttattctattttctcatctatatatcaaagctactatagctgaacttcatagaatcacaaaattctaaggcagaagctcctagaaaattaataaactgatctatgataaatcaaatcatattttaaatttcctagggatgctccctacttaagaaagccttcaactgaagtttgctttcactttgttttagcatatccagttttcttaagttggaaattactgtaagtaaatgtgagagtggtacacgcacaatcatttgctttctctctattctcagattatcttgttggacttttaacccaaccacctgctccaaaccaaaatctagatcaaaataaatgttattgactccttaccctatataggatttctatttgattgctcagaaactccagtatgacacctgacataagagagtaaaagcacaacccaagaggcgctccagaaactggatcagcagagacatcttcagaggcagcagacctcagctgggttgaggaccaaacaccaccttcacgttatgtttttcaaggtaacaacacaacacaacagagagaagaggacacgggatgggaaaccaagagggctggcctctaccattcttgctttccaacagattttctgtggcaaggctctttcccttatcttgcagatgaaggagtaaatcatcttcagtgaaattcagctctctcccattaactcattgatttattcacttaactatcaaatgtttattgaacacctacttgcactaaactctacattaaattctagatgtgtggaggaaaacagttaaagtccctccagtcttggggtggggggacaagtaatcactgagcaatccagatgggacgtgttatgaattagataaacttggtgattagcagaaggaagtagaggagagaggtccatttagagtggtcaggaaaggcatcacagaagagggggcaggggagaaagatgagttaggttagacggagaaagaattacaagaacagggaagacaatggatgaaaatgtcaagagaattaaaatgtcgtgagctaacagggtctgacataagatgacggcagagaggaatgcagaagctaggtcaaccaacggccttgtaagccaagataaggagtttttacttcattccaagttaaattgatacattttaaatccacataaattgcttatgctgtagaaggttctgagaactgtaaaaaccgttccctttcttagtattcctgccagaattgtcgacaaacatcacagctacacagaggtgcacagaagaaagagatgataccttgaactttccaataacggtttcttcattttagttttctctttcttttaaaaaatcaaatgggttacaaaatgcttgcggaagcgtgagaacaacagtaacagtttctgcctagaagaatcctatttttgcttccactaaataagcacaagtctgttgtctagtatttggcttttggacaaaacataagagtcagaaaatcacgaccatggaactagggtcaaaattaagtagttgattggaaataaaagaataaatctaatttctgaggactgactatacgtagggaagggaaaagggagaaaagggcttttacattcccttcatgtaccatcctcagcttaatagccagagaaatctagaggcccaatgagatggatcatggggctctttaaatatattttaaagcattcttttcctggtggaattttcagattgtaagtttgttgttgatttgggattttttattatttatttatttttatgtactttttttttttttttttttttttgagacagaattttgccctgtcacctaggctggagtgcagtggtgtgatcttggctcactgcaatccccacctcccaggttcaagcaatgctcctgcctcagcctcctgagtagctggacttacaggtgcccgccaccacacccggctaattttcgtatttttagtagagatgagttttcaccatgttggccaggctagtctcgaactcctgacctcaagtaatccacctgccttggcctctcaaagtgctgggattacaggcatgagccaccacgcccaggcctggatttttttaaagacaggtgtgtatgtgtgggtgcgtgggtgtgtgtgtgtgtgtgtttggggaggagcacacacaattgtatgcaatgacattattggtgggaagaataaacaactgaagttatcaaaactttctaccagagcactggtaaatatgggttgtcatttaaataacatatccctaattttccatccactgccatagtgcagaaacaacttaattacaagtgtccatgggaggctctaaacttctgaggtcatggaaagtgtcattcacagtcctctgtagtctctgctatgattatcaccatgtccacagtaagcattcagtataaatttgtgaaactttattttatacaaacataaagctttatgtcattttccatttaaggcaaccagttttaaatacaacactcaaaaaatgaggatcaaagttgatgatgtagatattgtaaaatgcagagtactagcatactgaatgcatacttatgcactgaatacctactgtgtgatagatgtttattcagtgctttacttacactgtctctaactgctgtagcttttaagactatccatttttgaaaatgctggtgaaaatcaagaatcaaggacagcgaagacgacagttagtgatagtgtaaaaaacggtggctgtaggcatagttttaaatgttcttgagaaaggattactgttaactgcggaaatgtagcaagtgtatctcctatgattcatgttacaaatgtaaaggtggtgtacatttattaacaaatagctggatttaaaaattcttcagtcattttctgttgaaagttttatctacatctgtactttatcaaggcctatttagtttcctacaaaacaacaaaggatacgttttatctttaaactcaggaaggctgtatgaccacaggttcaaaatgcatcctgaggggattctacacctgccgcctcatggtgaaactgcctgaaaactgtctccagggagagcatacagaaatactccggcataatacagaaatcgccttttcgcaggaaactagatagcttgttaccaatctgtttggttggggataacgcatagcaatcctatcctttgtttttcctgatttttactgttcttaacatgcccaataaataccttctcactgttcaagaacaggagtgctgataaacatcatctcaaaactggcatctacacccataatattatattatataataatattagaagcactctccagccactgggcaaatccttcatgagaaaacagcatccatttgaagttgtgaattcttttcttctttaaggatggatttctcataccctaccagaatttttgttatcacaaaatgcacactcttttttcagaattcctgaataatgaaaaatacagaatttatgatcctttgagtaaatttctaacaagtgatgaaattccgatgaagtgtataatgattcctcattttctttatgaaatctatcagttcaactctttgccttgaggacagatgctaaacagttgctctggcaagttattaaatcaagtttctggtttcttgcagggcctttcaacatatccccacagaaagatgaggcagacaaagaaactctgtcaatacacctcatatcattaaaagtaaaaaagattaattcctgaaataatgtaaatacatggtatttttcatgataagcatttgaggacatttttcccccatatcccttaacaactagaattaaatccctctataatgactcatttagaatacatttatttaacaaaggaaaacaaagtaaactgactccattggacaagtttgaaaataattttatgaaaacatgttgaaattaaaaccaagtgtttctgatttgtgattctacttggttgggccagtaactttcatgaatataatttcatataccaatatgaatgcttaatgtactaaataaacaagttgtaaaaaattaattcttttctgaaatggtatccatcacattgcttcagtagaatctttattgaaaagaaaggccagtgcaacgcccaaaagaaaaaaaaaaaaagaacacattcatactccatggtaatattttgcacaattaggtagcattttacattaaaatctgcagaaagcctagcaagagtttcccattgtgataagggcaaaaactaaacatggccattttgtaggccctgattgatttaaccatttttttctctgtgtattttcaaatatcagtaatgctgagaacccaattccaacatttatgatggcggcattcttaaaatatgggacatacaatacaaaatcagcaatttctgaacagtggtacaactgccagtaatcaatggttttttaaattccttattatcccatgggccatttcaaatagtttgtattttccaaatttcactccctttttaatcaatgcatgtgacattctgctgctgtaaatcttaatggaaactatataatttgatcatcatactacaaaattactttcatttaagaaactatgctgccatcagtaaaaatgcatctaaattattatttactgaactgtagtaaaaccctcgaattccactaagaagagtagtcagcataaaggaatcaaaacagcttttccatttcagaactttcacaattgtcaaacaactgctttatcatcatgatgtacttaaattcatttctactattgaatatcaccctctacaaaaagtgttattcaattacgtggttccacagcacactggaggtcagctgttaatagcaaagatgtattatgatgtgcttttattatttctaaggagtgagaaaaataatacgttgtattacagaacctcagtcacagtcaatgttttcattcatttgtaaaaacaggcaattgaatccagaagcacacaaaagagaaaaaaatcttttcatggagagtaattaaagaaaactcttgactttaccatcactaagcagtgaacaaatccacacacacacaaatctgaagttgcattaatgcagacatacaactttcaaataccctttagccaatgtttgagttgctaaaacactagtaatattcattcaaggtgtcttgtcctttaaataccattgctcaccaacaatttaaattaaaaagaggaagcataaagtttgggaattttttcatgaaagtaaaatttttcctgtaatcccagcactttgggaggccgaggcaggcagatcacaaggtcaggagttcgagaccagcccgaccaacatggtgaatccccgtctctattaaaaatacaaaaattagccaggtgtggtgatgcgtgcctgtaatcccagctactcaggacgctgaggcaggagaatcacttgaacccgggaggtggaggttacagtgagccaagatcatgccactgtactccagcctggacgacaaagcaagactccatctcaaaaaaaagaaagttaaatttttattttagtgccataattcagggggaaaaaaaataagaatcttttccattgctctggggagaaacaaagtatccaaccatggaaaggtaaaagagtacatttaatatttcaactcaagtattataatgacagaaagtaaatttctctatgttaatgcataataatttcccagccgggctcagcggctcacgcctgtaatcccagcactttgggaggccgaggtgagcggatcacttgaggtcgggagctcgaaaccagcctgaccaacatggagaaaccccgtctctaccaaaaaaaaataaaattagccgggcgtggtggcacatgcctctaatccaaagctacttgggaggctgaggcaggagaatcactggaacctgggaggcggaggttgcagtgagctgagatcgcgccattgcactccagcctgggcaacaagcgtgaaactccgtctcaaataataataataataatttcccaaagattttgtgccatttgctacatactgctcttcctttgtcacccttggatgcccaattcttatgcaatgcattcccagccccaaattattttaatctccctgaatactctgatgtgtttaccacaatactatctcagttactgccaccattaaaaatagagtattccatataaaagtgagggtttgtttctctaaactatacctattttcatactttattgtaatctttattcttttctcaatgtattaaatgtcgttctgcttttttgaacaacagaatgatcatttcctgataaatcagggtttatttatactgtttaagtaaattcatttatacatttggctttagatctgatagaaggccttggcagaccactttattttttttaacgtgaggactctcaattactttgtgtcactttagtttgctctcctactttttgtagcttttgttctcatctactttcatagcttttaatttccctgtcagacggttgcttggatttttctggaatttatcagtgggtcagcagttggtctacgtttatataggacagaatggctgccagataaataagcattttagtgtgtaaagtaaaaaaaaaaaaaatgctctgagtgaggtttctgggcttttacttgaaataaagtactgtgcttatttggtgtgccttatcttctgtggtcttttttttatacttcttgcttctcagttggatcagcatagttgaggttcatggattcattcaacaaacatttactgattacctactacgtgagttcatgagaataaagaaacagtatccctgtcttcagaaagctccagttttgaagagataaaaataaagccaacaaggacagttgggagttttttgatagacatctgtaaaggagagctgcacaagaggttctccctgggtctttaagaaaagccacaatataagaggtgcaattttttgggtttcttttagacagagtcttgctatgtcgccccagctggagtgcagtggcacgatctcggctcactgcaacctcccgtgttcaagcgattctcctgcctcagcctccccagtagctgggattacaggcgcccgccactacgcccagcgaattttttgtatttttagtaaagacggggtttcaccatgttggccaggccagtctcaaactcctgatcttgtgattcgcccgcctcggcctcccaaagtgctgggattacaggcgtgagccactgcgcccggccataagatatacaatttagttcagcctaaaaacaagaggaaggaggacattttggggagagttagcactactgaatcaactggattgactggagaagtttgtattattcataaagacaatttccaattacataaagaattttaagcagttcaccataaaagggttccatcaaatcagcagaagagctggtcagataccaaattatgaaaaagtacttggggattataccaatagtgaatctggaaatctatttagacttcctctccagaccaaatatgcaggatggtaatagactattctttgaggagatcagcaggaaagtgaagaaatatgataaagtctagaagcctagaagtttaaagtgctctttttttgttaaatgagtacttatgatattacataaaaaatattctgctttgaattgtctgagttaaatgaatattcccagattcagaattctctgttccacttctcccttaaaaattattcctctttaccctttcagttccaccattccaccacctcagtctccctgatgtcattaatgtccctgctattaccaagtccaatggacatgttcagatccatcaacagcatttgagagcagctttcctccaaacctctatgcatgcggcctctaggacacaaccttccctggattttcctccaactctattgtttttctttctcttttctcctgtttcccctcgacttctcatcctcacctctattaattctattaactggggaacccaaagcttgggtcttgaaccctacggcattgttattctcttttttgttgattttgtctaatcccgtggctctgtcaccatttatatgctagcgacttccaagagaatatccccagcccagttttctgagttctggattcaagtatcaaattgcttatttggcatctccagaaggttatttaacagacagataaaattcaatatgtcccaaaccgagctcatgattctccattcaagccaaacaactctaccctcctccgagtgtttcttatcaataaatactacaatcaccccaacaggtgctcttaacacaaatctgggagtcatccttgacatttccttatatactcaccctcaatatatgaggaaataatttacttcctcttgtttattcaacctgcctacatatttctggcatccatccacttctctccaattccacagccaccataagagtaggggccagcattctctctcacctgatcaaccactcttcccttgatgaacactgagtttacagagcaggcaaagttcacactccacaccagagccagcaacgttgtgcagggttggctgccttcccccctcccactccatcctctgcatctccctacacactccctaaactccagccgaattggtttcctctcagtaatataatctcagtaggcatttctgaatgaatgacggaagaaaggaaggaaggagttacagggaaggaggaaagcagagtaggaaggaggatgggaagaaggaaaaaaaggaataggcttaaggtcattaaaaagaaaatctgttcctggaatcagaaaatctgagtttgagtcctagctcattacgtagagtatcatgaacttgaaaatggacttaatgtctcccttacaggggatgcattaaaggttaagtgaggtgatgtgtatgaaagttgtctgtacactatcaaagcactgtacaaacagaatatggaagcttaagacaggtaaaatacccgaggagcctatcacagagataatgcaatttagatggtaaaaagaaatgaggcgagcggatcacgaggtcaggagtcgaagaccagtctggccaaatctctactaaaaatacaaaaaaaaaaaaattagccgggtgtggtggtgtgtgcacctgtaatcccagctacttgggacgctgaggcaggagaatcatgtgaacccgggaggtggaggttgcagtgagccaagatcatgccattgcactctagcccgggcgatagagcaagactccttaaaaatataaaaaataaataaataaaaagaaataaaagaaagttcaatggctctcaatctttttctccctctattgtccacaagtcataactgtataaattcatcatatccatgtaaaacaggttataacacacttctatctgagcctctccttatattactgcaattttcaataagtttaaaaaaagggctcagtgttgaccactccctgacccaaggattttcaaatttgtgtaattctcacaagaaaaatgtattattcccttaatgagtatgatcactttcctaaatttttgttgttgttactgttgttttgttttttgagatggtctcacttgtcacccagactggagtgcagtggcaccatcttggctcactgcaacctccgcctctgggattctgtgattctcctgcctcagcctcccgagtagctgggattacaggcacctgctaccacgcccagctaatttctgtacctaaatttgttttgaaacaaaagtattctataattttaacaaatgcagaggagcacatacaagaaacaaattcccagaagttaaggtatcaagtaatactagttttggattttgaattatttcctgattacttgggaacatcattttccatttctaaaccaacatttccttgtctcttaaaattcataagaagcaacagcaaagaagacataaaagatatatctgcttcttaagttagacagcagttaaacacataacaaattgagaataaaaaataatttatcatattcacataaaatagttttaaaggaagcacatacatgtcttggtagaaaatgtctttataattatgtatcacatgtttattacttactagattaaaacagtagtaataataatctactgctgatatagtaaaggcaattccctaggtgtttcttttggtaatagcacctagcatttatatttgttaagtgtatttttccatgagcagagttctctgaaagctctatcaatagtaataaaaatggccaactgtgattcggagcatttagtcagcactgtatccatatgtgtaaattccaagccaggcattcatttcaactcaattctgctgcttcactactgctatcttgtcgaccagaaaagtacaggactcaaattctcccaaagaactgccagactcacttagtccaagcaaaggagaaaagaagccaattatgaattttattacttccacaattctcctcaagagaaacattataagaaagaacactgaattaaaaaaaaagaaaactgcctcgtttccaagggatcttgatcaaaccaagcttactacggaagttcttctgaaattagatataataggattttcagggaggtttgatatttatcccaaggtaaaacaacttcttaccgctttacctttcctttatttagtctgactcgaatattattgtagttattggattagagattcattttaaaaagcaacttttcagacttgaaatagctttatggaagcatctcacatttcagcagctaaagacaagtgttcatggttttgccaattcaattcactagaagccatctaagtctgcatggtctctcttttttttccttcccctactgtggctttgaagtttaaaaagaacttcatatatttaggaaacagagcgattatcccaaggctctgaacttgagcttaagaaaaaaaagcgctcatctcaggagcagagatgcgtgagcatatgccaggcaggaatgcatgtcagagtcctttgatggaaattcacagtctcagagatgtacccaagcaaagcacaacaaacaatgaaagctaattgccaagagtcagggttgtcttcataatgcattgcatctgcatagcttggcgtccagtgttaattaaccacagccaggttgggattgcttcctgatttcactgcagcatgcctctgaagcaacagcaatgtccacaggttagcattatcctcccgtgccactgtccccgctggacagcacaaaacaccacaaatgaagaggcgaatgaagaactgaaatggcagttcttatgggatcaaacagaaaagcactgagttttactattttattacttcctttagcagggatcagctccaatcaattaatgatttaattacctagactaattaagataatgaacaacagcaagcctacaatcaattagctttatccaaactttctattttgagtataggaccttaaggactatactctatgtctttgttgcagcaataaaatatgtgggtatattacggaactgccagggatgtggtcactcccaaccttaagcaaacatacaaggtcacttgaataattctttggtgacagaaggttgtgaaaggatgttacctggatgggcaatggatatttctccatcagaaatgcagatcttaaattgaattatgtctctcaaaagcaagtaatggaccaaagacaggaacatgcccttttggtcagccagcttctgtgatttgagttacttcagagtaaccatgtaaaaataaaaagcccctttcaaacatccagcagaaagtagcagtgtttcttgattacattgttcttgggacaaagtgttccttaaattacttagcatgggctaagaaattcatatatttcctaagaaagaagtacagacaagaagcaggcagttagggaggtgagtagtctaagttctagtttttcctttccatctgttacatctactttgaaatttaaggcttaatgatctgattccctaattatattgggtgttcctcacagagagaaaaggtctcctactattgggtttaaccatggccactactaaagtataatctattattgtctacaataaatatttttcaataaccttttcctcaagcaagaaaccatataatgcataccacagtgttcacatctgtcatctcccaggtaccacatctctcggcttacctatactggttgtgtattgtctctctcagaataaaaatgatcatagtgcaagtttccttgtatgtgccagcagtattgcactatgcttttaggggaacttcaaacttgcccatggataaaaggcattaagattttatacctcacaggctaagctagctctgcaccatgcaagaaaactgactcactttccaaatgccttctaaggcacctctgaaataaaggggaaatctcaatccaacaaaaatggatgccgtgtataaaatttatatctgttctttgttcagccaaccagttattgagagtataccatgtctcagccaatgtgcaaatagaacatagaaaaagttatttaatatcacctcatgtctgttagagtggttgttatcaaataacaaaaggtaggtgttggtgaggatgtggagaaaagggaacccatacacgctactggtggaaatgtaaattagtacagccattatagaaaacagtatggaagttccttaaatatgaaaaatgaagctacaggccaggtgcagtggctcacatctgtaatcctagcactttgggaggccgaggtgggcggatcacctagggtcaggagttcgagaccagcctgaccaacatggtgaaaccccgtctctaccaaaaaaatacaaaaaaaattagctgggcatggtggtgggcacctgtaatcccagctactcaggagactgaggcagaagaatcacttgaacttgggagtcggaagttgcagtgagcccagatcgcaccagtgcactccagcctgggtgacaagagcgagactctgtctcaaaaaaaaaaaaaaaaaaaaaaaaacagagctaccatgtgatccagcaatcccactactaggtctatatattcaaaggaaatgaaataggtatgtcaaagagatgtgtacattcccctgtttattgcagtaatactcacattagccaagatgtggaagcaacctaagtgtccatcaatggatgagtgaataaagaaaacgtcctattatgtacacagtgaaatcctactcagcctttaaaaaaagaatgaaatgctgtcatttgcaacaatatggatgagtctggagaccattatggcaagtgaagtaagccaggcacaaaaagacaaatactccatgatctcactcatatatgggatctgaaaaactgatttcatagaagtagaaagtggaatagtggctatcagaggctgggtagggggttgggaggggttggggagatgttggtcaaaggacgcaaaattttacttaagaggaataagttcaacagatctactgtacaacatggtgactacagaaaatgtgatactgcattcttcaaaaatgctaacagaggccaggcgcagtggctcgcacctgtaatgccagcactttgggaggctgaggtgggcggatcacgaggtcaggagatcgagaccatcctggctaacacagtgaaaccctgtctctactaaaaaatacaaaaaattagctgtgcctggtggcaggcacctgtagtcccagctactcgggaggctgaggcaggagaatggcatgaacccaggaggcagagcttgcagtgagccaagatcacatcactgcactccagcctgggagacagagtgagactccatctcaaaaaaaaaaaaaaaaagaaaaagaaaaagaaaaagaaaaatgctaacagaatggatgtaaagtgttctcataacaaaaattataattacatgaggtaacacattggctacttagccaaatttagtcattctacaacatatacattaaaatatccagttatattcagtaaatacatataatgttgtctgtcaatataaaaaaattaaaataaaaaagaaatcatttagatcctaatggaagagtcagtctacataaccaaatacaggaatcaaagaggaaaaaagtgactagagttataaaatatgtttggtgtgctaagggaaaggtaaatagggcatctttaagtgcaataaagatgggcaaatgaagataatagagagtgcctcaggaattaagcatgtgatctctgaagtcagacaacctaggtatgaatcacagcttattatttattatgaacaaacagcgaacaactacggacaaattacttaacccctccaaactacaatttaccctatcttaaagtctaggctaataagggttcttaaaacacatgattgttattaaataatctgcgtgaagcaaggtgcacgcacatcctaagtgcccaataaatattagctctttgttactaatattagaagcttttttcctggcaatagtggaccatatatgctcctggtaatgagctacaaccctttgcaagaaagcaaatttctgaaagacttggctctcttaaaggtctcagggtcaagtacattcagctcatgttcattagctaataacattcaaaaggtaaatcaagaggatattaaaaaataaggccatgcagggtggcttatgcctgtaatcctagcactctgggaagccaaggcggtgggtcacttgagcccatgagtttgagaccagcctgggcaacatggcaaaaccccgtctctacaaaaaatacaaaaattagcaaggaatggtggcaggcgcctatactcctagctactcaggaggctgaggtgggaggatcacctgagcccaacaggtcgaggctgaggttagcagtgattgtgccactgcactccagtctgggtgacagagtgagaccttgtctcaaaaaataaataaataaaaataacaataataataacagtaataggatatcaaaaatgtgccctttcataattataaatgagtttttatgtcagaattaacaattaacgattttatatcagaaataataattagtataatctaaatactttagataagtcttattaaaaagactttatttctgagaactttacatatgaagggccttcaaacatttagtgttcacagaattattctcaggatctccatcaaacgaataaaactagccttaaactttaggctgaaataaaaattcaccttggtaagcactttgattatcaaaatatattgctttcaagtaacatttctactaagtttgggaaattaatttaaactccatgtgttcttatgtaattaatgctagatgtgaaagtatcttactttattttaatgtcagatatccaaaatgtccaatttatagtaacatttaatgttatttcatgccataactcaacataattaattaactggttgttaaatatcattataaaacactgtaagaatcactaccaatatatatgtaagataataatatatttcatcagcaatataaaataattgtcttggtaattaaggaagctcatttagttctagtaatagtttattcaaacatataattatactgtatagctaacaagtacgccttttaatcaaatatataattattaaaatattcttgagggatataattggcatattataaatatatttctatcatgactacttaaacctcaataaatgtacctttaaaaaggccttgatttaattagcatacagtaactctctccttgaaatgaaattaagtccttaagaaaaacaactaatatgaagcataatcttatattactcaaattactaaaccttgccaagcaaaaataataataaaaacccttcgagagctcatttaccaaaaatacaaagatcacgtctccaagcaataattctcagcctgattgcccagcaggaccatgtagggagcttttatgaaatctattagcccagaccccatctacagagattctgattaggttggttgggaggtgggcccaggtatctgttggttttgctttttagaaagtccataaaccaccacaccagagactgataaaacgtatttctcccagcccataaatgtttattgtagcttcattcataatcaccaaatatttgaaacaacccaaaggaataaataaaactgtgatacggatataatgctacgcaagcaatgatctattgatttatgcaacaacatggatgaatcttaaatgcattctgctcagtgaaagaagccagacccaaaaggctacatattgcggcagtgtgagggaaattctgaagtgaaggaactgctacatgtaattgtagtaatgaatacataactatgcatctgtcaagactcatacaacagtacaacacaaagagtggattttactctatataaatttttttaaatcgaccaagaagtaggggagggagggagatgcaatgcagagtgtgacaaatgaaataactgtcttacaaatgtatcacataactatattgaaggagacagggatggagctgtccttagtaattttggtaaacagtcttttggctggatattgtaagagtaaagacagcctgtatcaacagtattttcttgttctgaatgaaaaagaagtcattatttattacaaatatttagcttactgtttatcaattgtgtgtctttaataatgaacaacactaaacaatcttaaaatctgaaaggttttgtaaaaactttttactggtgttattttcgtcactatgtgccttttttttttttctttttggaaagaagctgggcaggatgagcatgtaaaggcttcttcaaagtgtgaaagtggacagatactgcctccaggatccagaacaacagtcatttacaaagctagagacagaatgcactgaaaatacagcaattttacaggtagttccagcaggggataatttatctaatcaaacagctgatctcctacatattctactgtattcagtcttttcatgttaataaaatttgaatatgcaaagatcgtatcaattcttttttggggggtggggggcatggactttccctccttgttgcccaggctggagtgcagtggcacgatcttggctcactgcaacctccgcctcctgggttcaagtgattctcctgtctcagcctcccgagtagctggggccacaggcacccgccaccacgcctgactaatttttgtatttttagtagagacggggtttcaccatgttggccaggctggtctcaaactcctgacctcaggtgatccccctgcctcggcctcccaaagtgctgggattataggcgtgagccaccgcacccagcctgattctttaatatgttacaaatctcaaaataaaaatctcagaaatctaggtatgtgtgtgtgctttttatttataaaacagaatctgagaggattaaaaagacttaaaaacaacaacaacgataacaaaacacaacttctcctgcataactgtcagtgccagaatttcagggtcaaacatttgatctgaaatttggtatccagttcgctcctaaactgagtctccaattgtccacttaaaatctttatccactgagcttttgcgggtggcggcgagcgcggagaggacgccatgaaggcctcgggcacactaagagagtacaaagtagtgggtcgccgcctgcccactcccaaatgccacacaccgcccctctaccgcatgcgaatctttgcacctaatcgtgtcgtcgccaagtcccgcttctggtacttcgtatctcagttaaagaaaatgaagaagtcttcaggggagactgtctactgtggtcaggtgtttgagaagtccccgctgcgggtgaagaacttcgggatctggctgcgctgtgactcccggagcggcacccacaacatgtaccgggaataccgggacctgaccaccgcgggcgctgtcacccagtgctaccgagacatgggcgcccggcaccgcgcccgggcccactccattcagatcatgatggtggaagagatcgcggccagcaagtgacgccggcaggctgtcaagcagttccacgactgcaagatcaagttcccgctgccccaccgggtcctgcgccttcagcacaagccacgattcaccaccaagaggcccaacaccttcttctaggtgcagggccctcgcccgggtgcgccccaaataaactcaggaacgccccggtggaaaaaaaaaaaaatctttatccactgacgcataacttggaggaccatggtgagaattagtgaggcctgaccttggtacacagtgactcaatttcaggctttgaatcagttagtcctatcagaatgctacaagtcagagtatcctggcaagaaatttactattggccataataatgaataacggccctaattaaagcctaaggtggatcagatgagaagcgggtcacaaacctaaagagatgatctatataatctacttgttcttggacatccatcacttcaggagaaaatttttgtgtctcagttatcagtgccatcaagagcaatgattattttccatattgtaatcagagtaatcctaacaaagcacaaatataatcatctttacctttcccctttaacagcttattgggtttttttttgttttgttttgttttgttttatatcacggcctcctttattctgccctttgcagacactagtcatattcctttgagccttggcacaagcttttttttctgcctgttggctcttaaatcccaacatcactagcaaactcctaaatactcctgttgcttccaggaagcctgacctccagatagcttggtgcgcagtagaatacctccccattataggatctctgtacaaggtttttctcctaatcctttacattttctccattcattccccttgctattcctagaacctgctagtcaaggtcctgccctagggtctttggactggctgttttcctggcctggaatactcctccccatggctaacttccctacctccttcaaatctttgcttaaatgtcactttctcactgacctgactacccaattttaaatcacatctgaacccctacccacccccatcatgcaccctcctgatttcccttactctggtctttctcccaccataatacttaggtcacctttgaacacataatatactttcctatttatcaattgtattgtttattatattgtatttattgttcaatttcataatttagagccccctagaatgcgaccttaatggtgcaagatttttttttttgtctgtcttggtcactgttgtatctcaaaagcctagaataaaaagaatatctctgaaatgaatgagttgcttaaggacctatatacaagacattcaagaagaaagagagaaagctcacacttccaagacctgaacaatatctgtgagttaaaatgtgaatgcacaaaagatctatgaaaaaaaaaaatagctgctgtaaatttaaggtagcaaattagaaggtgtcatcaactaagctcagcagaaaaagcaaatcctacagctacatcgaccaattatgagcctctaatcgctgccaggacctcaaacacattatcccagttaattctcacacaacacataacaactgcaggatgaggttctcacacccatttcacagatgagcaacctaagattagcctggaagctacaggagtgcacagaccctacctgttcccatcttgccatcataccaccagcatccagcgatatgctggcgggcagtaggtgtagaatatatagaagctgcataaaattaaaaaatatatatgctcagagaggttaacaaacttgaccaagaccacttatccagtaaatagcaaaatacaggatttgaactcagatcattttatttaaaaaccaatgctcttcccaccacaccatatttcttctaactaaagttataaaacacatacggacctacaaaaatgcaacagtcaggccaacgatctaccacagtcattcctcagggcctcttaacagagaaaaatataaattgatattcctaattagtgtcacctcaataatcaagcagcaatcatgtttcatttgatctctttaatattgagacaggcaaagtacattctagagacaattacaacaaaatagataagtttaaagtttagcaccaaatgtttagccttcagacaattcaaaagtcattttcacagaaatagtacacagacattacagtatgagtaaattcctgcttctacttagctgctcacttgggcaatgccctttggagcactggcccttgaaatgctaattcactggctgaactactgttcacctgctctttagccttaacaggtctgtggcttcacattgggtagccacagcagtccctaagagaaaaaaggagctccagcaaccaagctatttaattgcgaaaaccgcaattacctttgcaccaacctaataacctaataacttgactccagaggatggatgaaaccaggagaagagagggggagcctctctccccacccttgggctaggagacacctaaggtctgtaaacctggcattgttagaacctacaaggagaaccaaaggatttaaatgaataattcatcatcccaaattcacattcactagaagtatctatgtaattgtggttaaagtacttcaaatgtgtccttctgcttcatattttagtgtaagatactaggtaatagaatccattctctaattcactttacacaaacagaatcagcccaaatgtttgctgccaattcttacatttcctattgttaagcacagaaatagctggaaactgctggtattgagaaattttattcatttcagttctacaaatttctagaggccctacacagagattgaaagcctatagtcgcagacgagatccatcccaaagatgtacttcctttagcctcaatattattgtaaaacctaggggatggttcacatataaacctagactttaagctgcactaggaaaatcaaaggatccggagcatgcactcccaaataggaagaagagaatgggtggtggcttccctcatgagatacaacacaaactttcgaaacagttgaactggcctacctcaataatgaatgttactctcctggtcactggctgtatggaaggcccagtattggaatgtagggggttgggggtgaggcagaatctgagatgaataaataaacttgtatgagaattgaaaattttaggctgggcactctgggaggctaaggggagcaaatagcttaagcccaagagttcaagaccagcctagacaacgtggcaaaaccccttgtctacaaaataatacaaaaaattaaccaggcatggtggcatgtgcctgtaatcccagctactggggaggctgatgtccttgagcccagaaggcaggggttgcacctgtaccccatcctgggtgacagagtgtgtcactgtctcaaaaaagaattaaagaaagaaaagttagacaaatacatctaaaagtaacatatgaaaactatgatacctctaggagagacacaaaaaccgtatcaatgtgcattaggtgtgttggggggagaagcagggatggaagagaaatacacaaagtgtatcctccccaacctacgtctcatcctctctggctgtcccttctatgactcatcaagcacttataaagtcaactcatcatgacatcctgcaaattccacctcttgaataagttttgtatagggtcctttggtatcccatattcaaaaatacagttcagatcctcaagaccctcattctatttgacttcacagcagtctcctaactggtcttccaccctccaacgcatcctccacatagctgccagtgacctattgaaaattcaagtcaggccacaacacttcccagtttaaaactttcactgggttccctagtaatttgtaatactcagcctcacttgagaataaactgaggggcattttttaaattagctatgcttgatcctcaccttcacatgtttttattaaattagttggtgtggggcctacatgtctacattctattccaagtgattctgatgttttatcaagttgagaatcaccgttttaccggacaagttccaagatcattagctttgccttaatgccctccacaatttctctgtctccggcacacctatgaacattccctgtaaattccaataaggaacccgctcctggtagcatcctgtgcatatatctacctcctgccctgaattccctttattataattatctttaccactagtctgacagcagtgacttgggtctatcttccttgtaactcaaatgcctgcaacatagtgagcactaaataagagtggatgaagacagcagaaaaagatggacctggaagaggaggtgagacctgaaaggcaaagctgtgaagtaagaaagggagaaggggagaatgcttgtaaagctggaaaatcagaaagcactttttgggctagcaaaatgttggtgatcataatttgtcaaagctttcttcaggctagaaaaagcaatctagtggcctgagtaaatacaccaaagggatttaagccaattattccctgcccagtaggggtgtcagattcatttgttaaactacaagctctctagagaaactagatctcagaacgcaagtaactgttttattataattatcataatacccctcgtttccctctcactccaaatcacaacaattgaaatgaaaaagaagtatgtgttgttcagttgctaaatagtctttttataaccttttctgatgtagtttggattatttcagaaatagtagttctccacagtggtttctgctgcttacatcaaatgagtcatgctgtggggctctcactctttcccctgagagtttacaccatagttgaatagacttaactattagtcattttccttcatattaagccaagagttttgtttaatctaattagtccgccttctctatacaattctaaacaacctcagtccttacaagaatataggtatgcccttcctacatctgcagaaacgtgtgcctcctatttactgccaggacaagctgaccatagttcgttcttaaattttcccacgtgagccagggattccaattctgaaccttctcattcccacctcccacaaaagcgtttcagtttgctggcacgatggagcgtagtgttatttccgagcgtttgctgctggatcaatggtgttttctcattagttttattttgcttttgatttataagcaccaaaatggtacagagtatatctacaccagaagcatctataatgtgatcaaattcaccatgacttttgtgcttttatttgcctttatgaaaccaatctcaggcttcgagacccatgattacaaactgtttcttcacagaccccttacaactttccaagcaaatgtaatactttccagcacttttttcctcttttttaagatgttcatagctccaaatgtcaggcacaccgtgcaatgaaaactatccctcagctgataaattattcatttttcaggagtttgcaatttgaaatggcactaacagctgaatacctgaagcacccccaaaagacatgaagagcaataacatgcaaagctttttctgcatacattttaaaggttaagcgccattagacatctatgtttatcaagagatgtgctccttgaacatatttcttctaattaatctgctcccaataaacattactaacaaagcaaagtgataaaggaggctaatcaaactaatctcttccctttaactaacttcatcaggttaaacaaggtcctttgctgatattctccactttctcctgtctgatgaggagttgcaggtgagtaaggtcaaaagcaggagtgatcaaactaggactcttgaacaatctggcccactgcacgtatttttaaataaagttttattggaatactgttttacccatttattttgtattggctgtggctactttcttgttacagtggcagagttgaatagctgtgatagagacccacaaagccaacaatatttaccatatagctctttacagaaaacatttgctgacctctggtcaaaaggcatgcaaaatgtataaggcttttaaaatgttagcgccaagtagggctttagctaatgtatatcaatgtgttcatttactctaaaaaaaagaaaaagaaaaaaaaaaaaccttgcatttaaaagtgtgttatctagaataccatctgtgttacagttccagaggaaactgcaggtctaagattgttcctcaagctggtagatgcttcattttgataacagtaatcaccatgtgtttcagctatttattgctgtgttaaaaaccccttcaaaaatggcttaaggcaaagatttctttgcacatgattcttccctccaggcctcagctagaagattttaaactccacctcccatgtggtcactcatatggcttatagtcatgaagaagaggctggactctggctggaatgccaagatggcttggctcttatatctagctcctcacctgggacagctgcaacaggtgtgggctggctgagtatttctccctctctgtggggtcccttcagcagggcagttgagcatcttgctatgatgactcaatatgtcagagagtgaaagtagaagcttccaggctgctgaagggccaggcccagagctggtgtactaccacttctgcaccctcctattactgatcaaagccagtcaggggactaacccacattcaaggagtggggaaacggactgcaccttgatgagaggaactgtaaaatattttggccatgatttccaatttaccacaccatgatgatgagtaaaaagtgacaacatgatcacaatgacaaaatcttgaaagcagaccttactgctgacaatttataatcaaattgacaaataagaacaagaaagcctaataaaagaatggaaatcattttatagtgaaacactagtcacacagaaatcaaaaatttccaaattgatgtgtttttttttaattgaaattagaagccattctaaaagccactcagtgcttctcaattcttacacagtgtgtaagctgtgactgtgacataactttcctccatgactctagggcctgaagatgactatcaatgaggggcatagtaactacaatgaacctggataactctggacctgatgcccactggcatctcttgggccctctggctgctgtgcattttgagctctcttgcctgctcttttcagctgttctgcctcttctctggacagggaatcatgagtgtgtgttttaggtccttccccatcacctattcacctttttgctctaggcaggtcatctactctgacccttggatttttttttttttttttaatctgagaagtgaggaggataaaaattatgttgcctacacttagaatattcaggaacaaatgagattaagaagataaagtgtttaaactggctgggcgtagtggctcacacctgttatcccaacactttgggaagccgaggcagggggatcatctgaggtcaggagttcgagactagcctgcccaacatggcaaaaaccccatccctactaataatgcaaaaattagtcaggcatggtggcacatgcctgtaatcctagctactcgagaggctgaggcacaagaatcgcttgaacctaggagtcagaggttgcagtgagccgagatcacaccactgcactccagtctggacgactgagtgagactccatttcaaaaaaaaaaaaaaaagaaagataaagtgtttaaatcattattcaagtattcaagtgaaaggtatcacaatcactgtggtaattaattaagataaaattaattttattgataaaaataaaatattaacaaaattaatataccataaaatagtttataataatggctaatgtttatttagcatttactatgtgcaaggcatagtactaaacaccttacattgcttaacctgcttttgtctttacagcaatcctataattatcatctaatactccagacaacaaaaactgagacataaagtgataaggcaatctgcttctggttttacagatattacacagaactacgatttctctttcccaattcgcacagctgatttcaagagcttgtgaaaggtctatcatatttctaacaaaatttctcccttccaaaccccatattaattagaagggcattatctatctctcctaacctctgctccaaccttctgttccaaagctttcacaagcaacatcagtggttctcaattgggtgattttgcccccctcaggggacagttctcaatgttgagagaccactgggttgtcacaactggactgtaagctgcttcctgagtagaattccttgataagaaaaatcatctcaataggtcaaaaatgttaaatagctgatttctccatacattaagtattactctgtgtgtgtgtgtgtgtgtgtgtgtgtgtgtgtgtgtgtgtgtacagagagaaagaacagaatgaaaactgaacctcacaggacttcacattcaggatctcatttaaacttcacaggagcctgtgagagctgtgagcattgccaaagggtcagaattctcctacctattctcaattatcctcccaggagaattgagaaaattgctcctggtaggcaagggagccattatttaaggcaaatctggttactaacaccatgtactattttagagaaaacatttaagttatggtttaataatcattttatgtattaccttacattcccattggtcttaaaataaatccaaatatgttaaatcatataaacaataaagggtttttttttttcttaaatggaagaagtttaccaggaaatattttattaaaaagctttaatctatatagggacttcaacaaatcacttaggaatcctattgctgtaattttgacaaaatggaagcatatagggaaaagccctattgaagttcctttcttccctgcaattctatgttgaccatcaccctccaataacagccttactttacaaatgtaccgtccttcactatctgcagctatggatattgatgaaggaaagtgtagacttaattgcatgtttccaatgtaaaactatcatctgctttaaaagaaaaataaaactgaccagagataacgagctaaaagcagacatttgtgcttttatttaccaaagtctttggtgttgcaagtctatatcggctggtgcaaagaaaatttcagttaagctgtttagacagtgagtttataacttgatcaggaggttgtatcaaaccttcaatgcactatttgtggaaaaatatatacacattttgtcctagtagagaacagtagtacctaattcaagtttaataaatagatgtcccaataatatatgtgtttccctacatactctcctatacctagcccagcaatccgaaccctttatacgacctccagggccccatgatgtgtctcctggaccttattttgtcctttgaacacactaggctccctccttgcactaaggtctttacactcattcccccatctgcctggatgctctgaactccattttttcatagctggacccttcccattcttcggctcaagtgttgtatctcactcagtaacaccttccttgacatatgacaaaccaaaccaagacctatcctctcccttcatatcctctcttactctcatattacatcatgctgttttacgatctttgcagcatttatcactctccaaagtcacgccgttcagtgacttgttgcccatagccatgtcttgctgcactgctcctttctccacaacatcccaactagaatataaagtctgtggtaacaggaatctggatctggcttattggaggcacactgtagtcatgcgctgaatgaaaagtattattacttttaaatgaaatgttactgaaatttgttttaaaagataagtatagatattagaggagtttctatcaacctaaaatcactgtagattaaaggtttaaatgacttttagtgacaaacaatggcattttatttttctctcactcctttataagcatcttaaaaaggtttaagtatatgtttctctatatatttatctttacacacaaaaaaactaagaaaacatacttggtttagtagatttgttatactttccgtatttttagcttaaaaggaatagattgtgtgctattttttaaactgacgatttaagtacttagtgtatcttaaagccacatttaataactgtagttactgtaaataactgccacagtactatgttgatttttgaaaacctattgcaaattgtacagtgaatttaaaacttttatgagagaacaaagctaaattgtaatgtcttttgtagtaaggcactgaacttcattgttttaaactgattctggattccacatttttaacagatattaacaaaaagataagtttagataaaactatctgaacttcatgattaaaaagtgaaattacaagactgagtaaagataaatttggggggaattttttaaatgccatgttaaaaacaaaggattacttataaggtactgaatacactttaggtcccttcttaacatggttttctccttcactctaaattttaacaatctgttggtggttcagttttagaataatgcttcttcacaaaggtcaattttaaaaaatgtttaagtgtcaagcagtctagcctccttaaacctctatcaccctggtcccttgtaccacatctactccgtaacttccaactagcctcttaacagatctcaaggccactctggctggcctccctccaaagaatttttccaccatgctgcctcattgctcttttaaagttgtaaatgtcttcctatagcagcttaaaaataagtcagtgattcctgcagttcatagaataaaaaccaagattttgaacaaggtttatggagccttgtcttacccagtctccaccacttagccaggctcatttatttttatcatgtctgtaatctcagcacgtcgggaggccaaggtgggtggagagcttgagcccaggattctgagaccagcctgggcaacatgaggaaaccccatctctaaaaaaaaaaaatacaaaaattagccggacgtgacggcacgtgccagtaatcccagctactagtgatgctgaagtgggaggatcacccgagcccaggaggcagaaggtgcagtgagccgagatcgcgtcactgcactccagcctggataacagagtgagaccctgtgtccaaaataaataataataatagctaaaaataagtgcatgtaaaaactggtaaaatctaaataacacatgtagtttagttaacagtactgtgcaaatgttaacttcctggttttgataatgtactgtcattatgtaatatattaatattaggaaaactgaatgaaagctacatggaaaattcctgtatgattgttgtaatgtcttttaagtgtaaaattatttcaaaatagaaaaaataaatcactccctcaggaaagctgtggattacttttcagaacagatgagccacttggctgcttattttcttccctttaatgcttgttactgttagaaaatgtaaattttaaaaattaatgttaaatatttggctatgccactagagtttaagctttttaggggcagggatcatattgcttttaatccacattttatcctcagtagttaactcaatgcttggcacgggaaatgtgtccaataaacatttattaatgggactgtgaaagacatgaatgagccaatcagtcaatgtcccttgaaatcataaatgtatataaatatacatatttacattttaaaaagattctgctcaaattgtgaagttaatgggataatatatgccaacagagatctaaacaaagatgcttctaatttggaaatgacacaaactaatgagaaaaaaaggcataatagcaactaacaacatttagtgaatatttaatcctattattcaaaatgctttacaaacagttatttccttagtccttgtgataactgtatcaagtgtgtgctatatttatcttcattttacagatgagagacacatagagatttgtaccctgtctgtggtcagagtaattatacagcagaagcaggacttgaacacaagcactctgctccagggtccacattctttatgcattacttactgccgagagacaaagtctgagaagattgcttgagagcatcctaaacactagctatgaattctgaagatagattacaggctggtgtaggcccacactgtttaaaatttttatattcccaccacttcacacagagctttccacatagcagacagacagacagacagacacacacacacacacacacacacacacacacacacacagtttagtgaagaaataagtgaagctaaagcaaactgaagaaaaaagaatatactaaattttaggttaaagaattggttctaaaatggtatctccatccaatcacaggacctttctctttaattcttcacttcatgatagaggctggcttggagtttctgaattaacaagaaacacatctacgtaggcaggaggggatggggctcccaaccaagtcaaggttacttgaaatgggtcaggtacagctgggtgtggtggctcacgactataatcccagcactttgggaagccaaggctggcagatcacttgagctcaggagttcgagaccagcctgggcaagatggtaaaaccatctctacaaaaaaatataaaaattagccaagaaggccgggtgtggtggctaacgcctataattccagcactttgggaggctgaggcaggtggatcccctgaagtcaggagttcgagaccagcctggccaacatggagaaactcggtctctactaaaaaaaaaaaaaaaaaaaatatatatatatatatatatatatatatatatatatatatatatatatatatatatatatatgacagccaggtgtggtggtgggcacctgtaatcccagctacttgggaggctaaggcaggagaattgcttgaacccaggagatggagtttgcagtgagccaacatggtgccactgcactccagcctcggtgacagagtgagactccatctcaagaaaaaaaaaaaaaaaagattagctaagcatggtggcgcgtgcctgtagttccagctactagggaggctgaggtgagaggatgacttgagcccaggaagtggaggttgcagtgagcggagactgtgccactgcactactccagcctgggcagcagagccagaccctgtctcaaaaaagaaagggaaaagaaaaagaagtagatcaggtacatagaaacagaatgagaggaaaattaaagaagttaagaatgttaagggaataaaaccaggagatcacacaacagtagaatcaaataccaccagactattacaaataataagaattagttcacaaatactgttgataattgttccatccttagagtttagggcctattcccaaatagagataacaaacaggtcacactttggaattgtttaaaaaagcaagtcctactatactcaataaaaaatgctttgaaatgtacacgtgttgattttgtgacagagtcttaatcttactaggtagctacagctctgctgggagcaattaattcaaaaagccacagaaactccacaatgaggctaaaggatcagtaaaatagctggaatactttccttgcttcagacagctggatgctgctaatttagctactttaaagtgaggggaggaaggaagagggagtaattttgccacacctctactaatttagagaaaagagaaacaatgaaggctgataaacatggctacgtgtttatcatgtaaacatacaggttactttcagattgcatatactaaagggactctaaccaaagaactagggtaagcagaaattgctttttgttttggtttaggtgttttttgtttgtttgtttgtttgtttgtttgttttgagacagagtctctctctgtcacacggctgcagtgcagtgatgtcatcctaggtcactatggccttaaactgggctcaagcaatcctccctcttcaacctcccaagtagctaggactacagatatgtgccaccacaactggctgttttttttccttgttttaacagctttagtgagatataattcaaataccataaagttctcccatttaaagtatacaattcaatggtatttagtatattatgtttatactcagtaccaacactctaatctaacttaagaacatttttgaggccaggcgcagtggctcatgcctgtaatcccagcaatttgggaggccacggcgggcggatcacctgaggtcgggagttcgagaccagcctgaccaatatggagaaaccctgtctctactaaaaacacaaaaaaattagccaggtgtggtggcacacgcctgtaatcccagctactagagaggctgacgcaggagaatcgcttgaaccgaggaggcggaggttgcgatgagccaagatcgtgccattgcaccccagcctgggtaacaagagcaaaactccatctcgaaaaaaaagaacattttcatcatcccaagcaatttatcttttaaaggatacttaaatgatagagataacactcataatctaaaacaaaaacaaaaagacatttttattttactttctaagaatttttgtgcagatgaggtcttgctatgttgtccaggctgatcttgaactcctgtcctcaaatgatcctcctgcctcagtctcccaatgtgctggaattacaggcgtgagccaccacacatggcaaaaaccaaaatctttttaataagatatgtttctggtgtaaactgactctgcctactgaaatgtatgcattttaataatataagaaagttatcctttcctttcctaacttttttgggaagatctcgccaatttctgcaagatgcaatcatttgccctgctttcaacatcatcattttcctattcctttaaaaaaatgtttttggctggcacggcggctcacacctgtaataccagcactttaggaggctgaggcaagtggatgatttgaggttcgaagttcgagaccagcctggccaacatggtgaaaccccgtatttattaaaaacacaaaaattagccgggcatggtggcaggggcctgtaatcccagctactcgggaggctgaggcaagaggattgctggaaccccagaggtggaggttgcagtgagccaagatcacaccactgcactccagcctgggcaacagagtgagactgtctcaaaaaaactaaaaaatgtatttttttcctgcaagataattcctggtcatatcaatggccactcactctctttctcaccaagctcaccccctaccttcagctttctgaagaggcactgtattactgtgtttacctacagtaaatttctatagttccttcctgtgagctgctcaataaaatgtatgtaagaggcaaccgtacaaacagaggaaacgccttctactatccattctacccaagccaaattaattttaaatgtgtaattctaagaagcctttttttaaccactttagactaaagtagatatgcttcatatttcccctcttgatcttcaatttaatgcccggaagcaagggtttataagaactcctacatataggactttgcagagaagcaagctggagactttaacttgctacaagaaaacctggcttatccaccacccaaattttgataacctctaggtcaaattaaaaaaaaaaattagcacagtgcttcacacgtgctcaataaaactgtttgctaaatcttgttgaataatgatataataacagctaacattcacgaaacacctaccttgtgttatctgctaatctatgagttttcttttaattcagcaaatcctcgcaaaacccaggagtattatatcatgaccatcaccgtcatccacattttaaaaataggaaaactgaagcaaagagcaagattgatcaaaatgacaaagatatgggaaactgaggctaaaagcatgatttaccaaatcacagccagacttcaaaaccagactatggcttcagagctcacattcttaaccactactctatgctgcccatcaggaaatacttaagatagcaaatgattatcttacaacacagatgtcagtctatgctctaatgtcaaagaaataaagaaactccatggtctacagtgatataataccaaaggggtttgaggagggactcactgcttccataaaagacagaaatattgtgagtataggccgggcgtggtggctcacgcctgtaatcccagcactttgggaggccaagatgggtggatcacgaggtgaggagatcaagaccatcctggctaacacagtgaaaccccgtctctactaaatatacagaaaattagccgggcgaggtggcgggcacctgtagtcccagctactccggaggctgagacaggagaatggcgtgaacccaggaggcggagcttgcactgagccgagatcgcgccactgcactccagcctaggcgactgagcgagactctgtctcaaaaaaagaaaaaaaaagaaagaaatattgcgagtatatagtgactacagcaaggctctttaacaataaggaaggagaatgaagaagtattcacaatctgaagtggaaaaatgacaaaaagcaacaagtaaatggatgaactaaaccatctgaggaattaaattatgaagagtgtgtctctacaatttaaaaaaaatgttctatttctgagatcaggtaaacattcaggtttaattataatgaccacagtgtaaactcaggtctagaatgtaacagtatgctacaagtgatttcgttagagtgaaactggtctgacaaagaagatgctaacagtaggttcttggtctgcatttagtttttcttttttaaagactggtaaatagcaaacgaaatttatgtatgaaatacaactaacagaagctattatgaaaactcatccagaagaaaaacattcacctgaggattacattactataatctatatgaatctttaatctgcatgcatcttacagccgaatggttctcggagcactacctaaaccacaaaactggttggccagccctgaagaagagcttactcatgctgctcgaacagaagtcgcatatgcccttccctgagatcacagctctactgtccagacatgcattcaagaaacaacaagcaaaatcatctgggccattcaagacaccggaatgaacagaaatcagatacaaacacacgtctagctttttcaaataatagtggatatacaaggcattttaaactggcaatggcaaagactataattttctgctgagggatattatcacaattttccaacctaggtttgaaccaaggcttataagagccctcctccttaatgcaacatcacacccagtactttgctatgacattctatacagcagattataaccctgactctcaggctttttggagttaatcatttcaaaagagagtgagttggacacattaaattaacatggcaaactagagtggtttctttccattcccatccccatatggtcttctttttcaaaggaggacaaacatttgaaaaaattatttcagagttctaaaatgactctgacaagctactattaataactcttgatcctttggatcaatacgaaacacagttaggtaaaagggaaaacaaagaaggctagatgtgctaatgaaggcataagaaaacaaatcagtgacccaggcaataaaagcctgaaaaatattatctttatatatgatagtgaataaatcaaatttttctgtagtgttacttataactttatttttatttcagtgtttgaagaaaaggtaatgacagtatttgataagttataatctggatcctattttaccaattgtttttaaacatttttagtgactaaaatgatatctccgactctaccatgtgctttcacaaaccacaggtatcttctggtagattgcaaatggatgtcccttcttcttttaaaatgtaccttaaaagatatggttaaattttcctctttcgtcaataactttcagaatacacatgctattcaagagtgccaaatgaatctgtgaaaaggaaaatatactacatggaggctgattagacaaggacaaagctaatcaaaattgatttggccaagttgaagcctgcttcctctttttagctataatgggaggagtgagagggagtagattctttttcaagggacatcttaaggttgaaagctggtatcacaaaacatacagcatgataaatatcttaactaaaaattgctaacaagggcctttgtgatttcttttgtaagactacacagcataagaagtgtgatgaagaagaacgagaggaagatggaggagaaaaccagtaagatgacggttatctgcagaaaagattgttttttcaaacacaattttaaaagtcttcctttctaaactccacatctgtctgccacttttcaccagagaattaagcaaaggcatcactcctcagtagaagaacatttttagttatctggaaatataacttcatggacgtacaataattatatctagtaactttaagaaaaactctagctgtgatctgacattaaactgggctcccagggtctaaatgggcttttgccaaaaattaacaatggtgaaacaacttacttttgcactctagccaaacaaaaataataaaaccatagtctcaatttctctttaataaactaaatttagattacacctttaaaataagctttgacataaatggctttaaaataacaagaacatctaacatttgggtcttttcccagttaattatttgctggcattagactcgaaattccttggcttcaccttaagttgacactcccaagtgctaattaggaaactatatacattattaaccagagaatgttgtgcttaaaacatgcatattacatatgtatcttcttattaatgttattcctttcacttctcaaaatacctctttagaaaatagagctcctatttccatgaagcaattggtggctcgtgagggaattcctgtcaaaatgcaattaatagaaaggggccaagatgacacaggatacttgtcttggaaacatccttaacatgagtcaaatttaatctcactgaaatagtggagagaaatgttaatgactgcagatgtcacacattttactcatactaggtgattcccaaagaaaatggctaactcatgtatgaactaaaccactaccaaggaaccacacatgtcagggagtacaaggccgagacatgcctttctccaatactatctcttccaaaaagccacaggacagatgggaaaataaatgcaggtaaacaaggtagacctaatgatttcctaattaggaagatgtgatcttctcattaattgtcaagttaatggaccacaatagcagtttcataaattgagtccagtaatccaagctttggtgtctctagtccacagaattctcctcatacttccagacccttcatccagccacaaagttgtcagttctgcttgatttgtttcaatactgtactcgacgacagctgtcggaaacagtacattagaacagctgctatgacagctacaaggggcttggaagtttaattaggctcattgtgacattgtgcatttttctaaacacggaatgatccacaaaaataaagaaattttgagtgggtctgaacaatgtttacttattggcaccaccaactggttaacctcagtttgagttatatccttggtctcataatatctttgctaccaggctgataagaggtataaaaaaataaataaacaggaggagcagttagatgcacaagaaaaggggcattaaaacggagaggaaatggtgaggaagtcacgtcaataatctctttcaaaggctggctggtagccaaggaggatcccgcagtgtctcaggatttacttccaaaggaaatgtattcagaggccctgagcctggtgccaactgcaaacaaaaccactcattatggtcacagccccctagagaaggggagaatggcttactctcagcatccgtgcggaggaagaaagtgaggagcagcagcagcagcctggctacgtgcaccatcctgcagcttggcagcagcgtgcgcgagcagcttggaatcactgcctccggagccgcagcgagtctgtccgatctgaaatttcagctggaacactttcagagcctgaaagcggggaggaagagaaaagaaaaggaagaaaacacaaaagtgcttagatttcttactctttcccccctggttccatcacaatcaccatgacagacacaatccattgtaaatacacaataaattgtaactgtcatactttgtttgtattaggaaggaaataacttggtttgtaaaatgtaggagtcttagactatccgggtttgtgttacgtgggagctctcgcattcccaattttaggctctcctaaagccaaccaccttgactttcattctttgcttatgccaccttttgggcaaagacctaaaaaaggaactgtcacttcttatgaaacattacgtaaatacatcagtgcaaagaagcacaccagtgctatgagaaagatttaagagaagttcctccatgcaggataaaagtctattactgacacaataatggaagctgcttttttggcatcagttgaaatgacagggctaattcaacttctccaggtaaatagcagaggttagaattttttacactagcatatttggcttcttccctgaagacacatcaatgttcaagtctagtttggcatcaataagtcaaaacaatagttagcatgagcctctttcatttaacaggatttttatatgcctcctgggcaagggtttaatttcctcagtcttctctgtaaaatcaaaaagccacaaactatttttagagcacctactgtgtgcaaggcatcaagagtgacagcacaaggtgtctcaaggcagaaagatgagtcaggttctattatttttgtttccagattagtagggaaaataaagcaggtacaccagatgattagtacaatttaataagtgattagcgccaggaaggaaaaccagataatgctataaaagataggatcaagactgacatcatggaaatagtgtctcaaactaggccttgaagtttaaccaggattttaacaagatgacgaaaaggcattccaggaattctatgcaaaggcagggcagtgggaaaggaactttggaaaacctgagtttcctggtttggttggaatagggcctcccaaaggtcagcatgcacggggccccctggaagccttcttagaacagatgcgtgagtactaccatcagagttcgtgggtcagtaggtctgtggtggggatccaataattcaataatttggtttttttttgtttttttttttctgtttttttttttgagacagtctcactctgtcacccaggctgtagtgcagtggtacaatcacggctcactgcaaacgctgcttcccaggttcaagtggttctcctgtctcagccacccaagtagctgagattacaggtgcccaccaccatgcctgggtaatttttgtacttttagtagaggcaaggtttcaccatgttaaccaagctggtctcaaactcctggcatcaagtgatctgcctgcctcagcctcccaaagtgctaggattacagggatgagccaccactcttggcctaccaaagtgctaggattacaggactgggtcacatatttgcataaatttgcatttctacatgttcctgggtgatgctgatgctgccagtccagagaccacactttgagaaccttctggttgaagtcatgggaaaccatcttctattaggaaaaccagaagatgaagcaaaagaaaatggttcagagtcaggcgcagtggcttacgcctgtaattccaccactttcggaagccgaggcaggaggatcacttgaggccaggagttcaagaccagcctggccaacatggtgaaactccgtctctactaaaaacacaaaaaaattagccaggcgtggtggtgcatacctgtaatcccagctactcgggacgctgaggcaggagaatcacttgaacccaggagacagaggttttggtgagccaaggtcctgccactgcactccagtctgggtgacaagtgagacttcgtctcaaaaaaaaaaaaaaaaaagaagattcagactttaaaaaaaaataggtcacagagagccttggatggcgatctaagtcaaatggcctttattcagcaaactacaaaaagagccatttaatgttttagagcagaggaaccatggaaccaggctttggaaagattaactgacaactggatcagggatgatttagagaatgctattaggccacagcaagagtttcaggtgagaagtgacacaggacttaagagtaatggtggtactggtgggaattaggaagggaggcaatgactggctccaagcaatcatttgaagtataattcttcacgtgttaaataattgtacctatagaaccctcaataaatctagcacagcctcttatgcagagtacactcttaatgaaaaatttaaaaataaagagagtagatcacatcctactgcatcctctattactgcagaaaatatctgaaaatgactatcagtattcatttgcaaaatgaaactgcatacctttaatttttaaaactgaaatatttgaaacatatacaaaatttttgacaggaaatactagagatatccagcaataacctaatccactaaaataacttgtactttaaaaagaattataatgcagataccatagtatgtcatttctgaaactcagcttaagcatgagaacaaaaattgttttaaagatattaccttttttattagtattcataagcggtttgaatgcaggaaagataaaactaaaaaggagaggaatcactctaccattctattagatagtctcctttttttttttttaaacagtgggttggcatgaagaagcaagtggtacagtggaaaacttcttgaatccagaagctggccagctgttccaaatcagctattgttatcaatcgcctctgaaaatcaacttatcaagcagttcacagctatcagatgttaaaaatctcaaaagttcattggaaaagtgctaaaggaatcagctctcccctccccattcccctcctcccgctttcactgctcccatcctcatgccagcatttcaaatgacagcaaagtccaggagacatcagtcctgtcggactcaatttgtgtctgtgcaagcgtatcagagccaactgctacataatgactccgtgtgatcacagagatggagacctatgaatgctcactcagggaagaagtgatttggcttttcctcctactcagctgaagtgcataagaagaccaaattttttcaaatgaaccttcaaatgttactcctggactagcaacagtgataggatctagcactctagaaacgaatgcaggtataaacatacatatttatccttaaatgggttgtgcccaaaggaggtcagaggtgtgaagatgaaacgtattctaaatgttcattccagctaatctccattccttatcttgtttattacacagcaacattgccaaaagggaaatgctagctgcctatcagtaaggtggaatttaaatttaggtacaaaaattggaaatggattcttaagaaaataattaaaccaaaaataaacaggataaaagaatattataaggagtttccattaatctatagtaaggcttgctaagtactctgaaaaaaaaaaagagcaaggaggttcagtgatattaaaagtaccacgttttaccttacttccatcacacattatccagcatttgtccaatagcctcagcagaagccaaccctttgatttttatatgttctgctccttctttcttgagacagagtctcactctctgtcaagcaggctggagtgcagtggcacaatctcagctctctgctacctccgcctcctcagttcaagcgattctcctgcctcagcctcctgagtggctgggattacaggtgtgcgccaccacgcctggctaatttttctatttttagtagaggcagggcttcaccatattggtcaggctgatcttgaactcctgaccttgtgatccgctcgcctcggcctcccaacgtgctgggattatagatgtgagccactgcacccggctctctgtctttcatcagcagggacatgcagatagaactcaaccatgtatatgaatctaaaatacaatttcaaaaaatttataactccccggtttcttatttctcataccacaaagatcttatgaaacaataattttgctgaattccaattaactgaattgtatatcagcttctgtatatctgtacatgggtggttggagaaactaacagttcagagggcaatacgatgcatgtaatataatttgaaatggaacaacaaagagcgcacttgcctaaaagccttaacaaatcacggtttcaagcgatcacataaagtgacacctatccaactctttttcttcaacttaccattgtaacacttttctgtaataagtatattcatattcaaaccaatatgaatgttgaaggatttgtactattttttcagctttctatactgttatttgtgtctaaatactgtattaaaattttctttaaaaaaagacaaactagggcctagagtcccttagaaaatggcagattataggctttgtatgggaaatgtagaaaattagtcaacatcttgccataccagaagcaaggaagttgtcggaactactaggctatattaaaaaaaaaaaatccaagatgatgaggtgcctatcagctaaatgtagggaaatctgagtgacaaaaagaataataactgcaaagaactacaacaaatcacattataatctatgagttcataattttaaaaatttcactggttactctaggagaaagttagagaaccaaatcattactctgaaaacgggaacagaaaaggaaagaattaagcattaaaaaaacaaaaacaaaaactactgctgtcacttaaaactaggtatcattgtttatctctgaacatttttcatttttctatcataacaaacccatcctctcaagtctagacatctcagaagcaatatcataatgatatttaacctgaacatacatgcataaaagatatgcattaagttgggggatggtatgggaaggagtatgtccccaaattacttctttttatctacctcccaaaccaggcctctgtaaatcagctgaatgtggcttctaattatttaagagaaggatccatttgtacaaacgatgtgctgctaggactctccaatttgtaaaacagacaaaagcagggctgctctggctgaagcctgaaggaggggaggggcctggagcctacagcaaacctgacagaggcttcagggggcaccccaggaattccctaggccctcagtgtccagctacaacacaagtacatgaaaagagaagagaacccaaaagcaaactttcaacatttcactgacttgtggattttccaagagaagggagccatctaaatattttaacgtggtataaaacaagaatcttccagtactgacagatataactttcttcaggatagaaatgtttttttatctgcattgactaataattgaccactttaaacgtagctagtgcgactgaggaagtaaagtttttatcttattaaagttcagtttaaatttacacagccacatgtggctagtggctaccctattggacagcacagactacaactacaggtttacagcactgaacagaaagtcagtgttttttggaggtgtagactgaaacaatgaggtgagaattctgagttctcgtagtccttggcttcccaataaccagacactaaagattcactgtgttatgtgaggatacccatttaagctttggatcactcactaactgatatggtttgactgtgtccccacccaaatctcatcttgaattctcatgtgttatgggagggacccagtgggagataactgaattataggggcagggctttcctgtgctgttcccatgatagtgaataagtctcatgagatctgatgattacgtaagggggagtttccgggcacaagctcttttctcttgtctgctgccatgtgagatgtgactttcaccctccaccatgattgtgaggcgtccccagccatgtggaactgtaagtccattaaacctttttttcttcccagtgtctcaggtatgtctttatcaacagtgtgaaagcagactaatacactaacccacccatgtccctcatcctgccaaataaaagatttcattttttttaaattatttcatagaatgtaaagggaagatcagtctatgaccaaactaccctgaacacgcccaatctcatctgatcaagaatgcaaagggaagatcaataagtggttgagtatataactggaaaatatccaagtagaaatagtgttaacgaatgttcctttaatattaaaggaaaaattatgttaaagatggcgtttcatacttcattgtatttctcactacttctggcagcaaagaactgccacattctatagacataaaggacaagcatacttctaaacatcctcatgaaataatttgtatagttgtatagtttttataaaatggccacattcgattaatattagcgagggatacgggaaacacattcttaaatgtatgcagggcaccaaaagctttaatgtcaattacggaaaatattactgagaaaaggggccattgaacaaggttattgaatttaataaaactatgaaaaacaaccacaaaccaagcacctctgaataaaatagtcaaacctaaaaatataagaaattatttgtatgaaacttgtaacacctcaaaattatactccacataatcagcacatcaaatcaaaaactccaaatttttctgttttgccctaaacatgtttttatgacaatcagttaggaaaaacaacaagaggtagtttaagagctattacatataaacacaaagtgataattcaatcatctcatttttggcttaggctatgacttaatatgaagaccccaggggactataagcacacaatgattctttgaagaaatcaactgaattttaagaatacccgaagagtaaaacaattcctatcaatatagacacttaaaagatcccttatatgcctaactctaatacacagagaaaaaaaagtcaatagctattattctgagctttttctatagtttatgattcactttccaaattattattgatgcatccctgtaagatatcaagtggctttacattggaagcacatataaatattagttattttcaaggatggcaaaatgacattattaactttgattgtttctttctcctttgggaagaaaaaaatgaggtatgccgtgagaaatgaacagatagaaaggaaaaaaaaacctcatctccctttgtatctattgttcccctacaaatagaactataattctgatttgaaaagaaggatagctttagaaaaagaatctaaaatttctttcagttattactgcatgtcatagcttctatctagttttatgtgatgccagtagaaactggcaatgaaacggttaaaatacaagtctattcaacatgccgttggaactctaatatttgttcctttcatccaaaaagacactgtacaagtgagaaacagatctttctcgcaaagtgtagatagatatgcaatccagccactttccactcaaacagaacatggattctattattttaatctcaggcatttctttttttttttttttttttttttttttttttttttgagatgaagtctcattctgttgcccaagctggagtgcagtggtgtgatctcggctcactgcaacccccaacccccacttcccaggttcaagcgattctcctgcctcagcctcctgagtagctgggactacaggcacacatcaccatgccaagctaattgttgtatttttagtagagacaggatttcactatattggccaggctggtgtcaaactcctgatgtcgtgagtggcccatctcagcctcccaaagtgctgggattacaggcgtgagccaccgcgcctgaccgggcatttctttttttatgttaaataatttattaggatattctgttcaaccaatcaaaagaagtaattaatatgcccttgattaagaggtctagacaagacattttcatgctaggagtatcaccataagcctaatttatcatgaagcgattatgcacctgttccaaaatttcatattattccctatatttcacttttaataacctatatacatcaagctataagacattagttatgaccaataaactaatatgtcagtcaagctttaaaatttccttgatgacagactgcacacattacaataggatcttatcctaatagtaatgtatgatttgttgttttattttaaattgatatataaaactgtatatattatgcacaacatgatgtttgaagtatatatagtatacattgaggaatgactaaatttagctaattgacatatgcattacctcatatagttatcatttttataatgagaacattttacatgatctgtcttggcatttttcaagaatacatggatatgaaactatcatttctacatcaatataactgattttgtcatctttaaaaatcaaaacaggttttcttaatgaatgcaaaatatctgtaaaatacatttacttttcaaatgttatgggtaataggttttatttattattgtatctattttatttgttttagccctatcaatacatagtacggaaaagtctggcaatacatattttacttctttactatgaaaagcaattttaaaaattcactttgaggagaatttaccactctctaaagggaataatctacattgatctcttttccttaggattattttaagaataaagtgaaggaccttttaattgttttttaaatagttcattatgatagctcaaagaaaactaatttagcgcctcgcaggtgtaatatttattggtagctccatcctcagggtgatcaaatctctgggccagctgtaaaagtgactttgccctctccctcagggaatgcctagagacaatttttgttgtcacagcgcaagaagggtgacccatggcacctaagggtagaggccacagatactgccaaataccctataacacacagaacaactacctgccccccaacaagaaattatcccattcagaatgtcagcaatgccaaaggtgggaaaccctgtcctagaacagctcattggcacagaggaaaaattccaaattaaaaaaaaaaggggggggggacttttaagacataatctaatacattgctttctaaacccaccaattttaggtgttttcatacataaactcaaaacagatttgaatttctgggcatgggaatatggatgacacccaaatttccctttttgtcctaagttagaaccaaagttggcttgccttaaaagtttagttcacaggcttaggcagcataaatattgtcaccaattaaaagaatgaagctgttaaatggaacagacattgcactgatgtcagtcagtgaatagatatggttcccatgtctcatgatgggagcttagctcttctctaagggaacagtctcaggaaagaaatactcagtttcaaggactgttttctcatatcactgctagcaatagagatcaatagtggaacggtgaaaggctgtcataaatggctaaggaaagtggaattaaagaatattctcttcatacctctctcaccttatacacaaatcgactgaagatgaatcaaagagttatatctatgacccaaaaccgtaacaattctagaagataacatcagaaaaacccttctagacatcggcttaggcaaagacttcatgaccaagaacccaatagcaaatgcaacaaaaacaaacattaaatagataggacttaattcaactaaaaaagcttctgcacagcaaaaaataacaataataataataataataataataataataatatcaacagagttaacagacaacctacagagtgggagaaaatcttcaaaatccatacatcgacataggactaatatccagaatctacaaagaactcaaactcaaatcagcaagaaaaaaaaaatcacatccaaaagtgggctaaggatatgaacagacaattctcaaaaaagatatacaaatggccaacaagcatatggaaaaacgctcacaaaatgctccctgatcactaatgatcagagaaatgcaaatcaaaaccacaatgcaataccacctcggtcctgcaacaatggtcataatcgaaaaaatattttaaaaaatagatgttggtgtagatgtggtgaaaagggaacacttctacactgttgacaagaatgtaaactagtaaaaccgctatggaaaacggtgtgaagattccttaaagaactgaaagtagatctatcatttgatccagcaatcccactactaagtatctacctagaagaaaagaagtcattatccgaaaagatacttgcacacgcatgtatacagcagcacaatttgcaactgcaaaaatatggaaccagcccaaatgcccatcaatcaacgagtggataaagaaaatgcagtatacttataccacggaatatgactaagccataaaaaggaatgaaataatggcatttgcagcaacacagatggaattggagactattattctaagtgaagtagctcaggaatggaaaaccaaacattgcatgttctccctcataaggaggagctaagctatgaggatgcaaaggcataaaaatgatataatggactttggggactcaagggaaaggctggcagcagggtgagggataaaagattacacattgggtgcagtgtacactgcttgggcgatgggtgcaccaaaatctcagaaatcaccgctagagaacttatgcacataaccaaacaccatctgttcctcaaaaacctattgaaataaaaaataaattttaaaggcagaacattataatcccaacgttgtcctcatgactattcccacatctctctaagatactattaacaatttacatagtagagaaaataggttgtgtggggaaactaaataaatgactatcaaaccaaacagaaacataaaatctaaagaaaggtaaagaggacaaatattaaccatatatatatccaaaatacactcttcacttctctcactctgtacatatatttcattcagttatattgcactcatctttactgttagtgccctcttcacatctactccctccttcaatgaaaccacagactgataaaaatcagaagaaaaaaataacatcattttgggcaaccctctcatttaacagacaatgcatgaagtacaaggacataatggaattaataacctcaaaatgcacaagtgagtagtctcagaggagggcttagaaccaattttctttcttctatagcatggtgtatctacttttactatctctgacttactgcaacagaaatagatagctgaggcgatgtcatgattaattccaaagtgatcaacataaagaaaaagtccctcctttaattagcaaagagacaatattacaatgggcataaacgaaaggggaaggcaaccttaaaggcggggtataggaaggcaggatgaaagaatctcactgaatgaaggtatttggcagtcactgtcctagaccaataaataattcacaaatgaaagtttatcctatgagtcaaaaattttctaaagggtcaatctttaacttggtacctgttattatgtacctgtgtatcttagagtaaaagtttatagacgtgcttggaaggaaaaatgattaaccagtaatagattttctaaattctcacgtttgtaattgaacgaataacatgcagacacatgtttataccaccttaaggtatacctattttgcatattaccatcaagttctattttatggagtttctctctctctctctctctctctctctcttttagatagggtcttgttctgtcgcccaggctggagtgcagtggcacaatcacaggtcactgcagcctggaaatcctgggctcaagctatcctcccgcctctacccccagagtatccgggaatactggcaagtgccaccacatttggtttttcaatttttattgggaaggggtcttgctatgttgcccagactggtcttgaactcctggactcaaaacaatcctcccaaactggcctcccaaggtggtggaattacaggcatgagccaccatgcccaatcgattttttttttttctctgtaaaatttaaatgtcagcaaggacatatgttgagtaattgtgacaaggtgggaacgggttagattctgaattcacagagttatacagtctggttatctcagtggagagacaacagcctgagtgcactttattacgaagttgctgagggcaacatggccatattgaaagaagaaatgaagatacacaatggttatttttcaaaagaagttggcgttacaaagtgatttgataataaagtacgaaaatttcctgcagcaataaaagcactatgcatttcccataccaagatgtatcagagtggcagcgaaaaaaatattattccaatactcactcctttagaaaatatatttgagacctctggaaagactttttaaagtactgtcatttttattgtacttctataaaatactgaaacaaaatacacaatatggatatcaaaaagggagtttaaagtcattaaaagcctgctagcaaactagctgtagtaactttctcaacaccaaactttctagaaaccaattgttatcttaaatgaacagcccattaaactaaaagaaaagaaaatgttgaataaaaacatcgatcaaacttctctgctgggtcaggcacgatgcctcatgcctgtaatcccagtgctttcagaggctgaggcaggaggatcacttgaggtcaagagttcaagaccagcctgggcaacataacaagaccccatctctaaaaacaaacaaacaaaatttatctgttggatatgggtctcacataggccttttgaaacccagatatttatatttcaaagtagaggagtagtcattctaaaatgagtaggaataggttcaggaagcaagccaggagtgtggctggcaaagatgtgcaaggatgggtggaagagaagtgcagggaatgcctaattgttatctggtgcaggatcaagccccaaattaaaatgccatctttttaagaatttctctatcttttgtggtgtacctaacaatgtttccatcacaaactgaatatagactgaccctttcctttattatgtttcctttaatatttttaaatcataggtttaatcatgaatatttatattgccttgtttaaaaaaattgaacagccacactttagaaaatgtgcttacttcactaatagccctcactcaggcactagaattaggaaaaggaaaaaggataaatatatatacaggctctaagtatgcttacctagtcctccattcccatacaacaatatggaaagaaagggaattcctaacttccgaggaaacacctatcaaacatcaggaagccattaggatattactattggctgtacagaaacctaaagaggtggcagtcttacactgcaggggtcaccagaaaaagaaggaaagggaaataaaaaggaaccgccaagcagatattaaagccaaaagagccacaaggcaggaccctcccttagaaatgcttacagaaggacacttagtatggggtaatcccttccaggaaaccaagccccagtactcagaagaagaaatagaatgaaggacctcacgaggacgtagtttcctcccctcaggatggctagccaccgaagaaggaaaaatacttttgcctgcagctaaccaatggaaattacttaaaacccttcaccaaacctttcacttaggcattgatagcacccatcagatggccaaattattatttactagaccaggccttttcaaaactatcaagcagatagtcagggcctgtaaagtgtgccaaagaagtaatcccctgcactgcaggccatacatttcaatccctgtatctttaacctccttgttaagtgtgtctcttccagaatcgaagctgtaatatatatggttcttcaaatggagccacagatgcagtccatgactaagatctaccgcggacccctggaccggcctgctagcccatgctccgatgttaacgacattgaaggcacccctcctgaggaaatctcaactgcacaacaactactatgccccaattcagcaggaagcagttagagcggttgtcagccaacctccccaacagcacttgggttttcctgttgagagcggggactgagagacaggactagctggatttcctaggcggaataagaatccctaagcctagctgggaaggtgactgcatccacctttaaacacggggcttgcaacttagctcacacccaaccaatcagagagctcactaaaatgctaattaggcaaaaacaggaggtaaagaaatagccaatcatctattgcctgagagcacagcaggagggacaaggatcaggatataaacccaggcattcgagccggcaacagcaaccccctttgggtcccctccctttgtatgggagctctgttttcattctatttcactctattaaatcctgcaactgcaaaaaaaaaaaaaaaaaagaaaaagaaaaagaaaaagaaaatgcgcttacttcttcccgtaattgtcactagggtcaaaactattcattgcataaatcttcatcactggccaggcgtggtggcttatgcatgtaatcccaacattttgaacagccaaggcagacggatcacctgacgtcaggagttcaagaccagcctgaccaacatggagaaatcccatctctactaaaaatacaagattagccaggcatggtggcgcatgcctgtaatcccagctactcgggaggctgaggtgtgagaatcgcttgaacccaggagcgggggttgtggtaagccaagattgcgccagtgcactccagcctgggtaataagagcaaaactccatcataaaaaaagaaaattcatcattttctaacttgcactttagattggtccatacactccatcacacaaatttagtgcttatttcaacacacatgtgaaaatatgtatttatatattatatacatttactatgctactaatgaactaaatacattttcaaacacagaattagaaattttaaaaataagaaaaaaaaagtagaagttctataattcttttcctaggccatataaataattaggggcccattgccctagatatagttgggattttttgtttttgttctttgtgttgagacagagtctcgctctgtcgcccaggctggagtgcagtggcaccatctcagctcccagcaatttccgcctccgggttcaagcaattctacattctcgtgtctcatctccctgagcagctgggattacaggcaggtaccaccatgcccagctaatttttgtgtttttagtagagacggggtttcaccacattggccaggctggtctcaaactcctggcctcaaacgatccacccaccttggcctcccaaagtgctgggattacaggcgtgagccaccatgaccaggtgaagtttggatttttttaaacctatattttaagtgaccatagacaaaaatgacatattttactagtctgtccaccaatctctatgtgacagctgatgtcaacaagacatattataacacatagagaagacactgttgtttgggattttcagacaatgtcctcatgttatcattgtaaaccatctacattaaagtagaataactttacacacaaacagtgtttgtgctttaaaaatgaattccttcattcttttattccatgaatatttctgaataccaggcaaggtgatagggacaagagacttataataaacgtacaagacagcaaggtccggctgggtgcggtggcttacgcctgtaatcacaacactttgggaggccaaggagggtggatgatctgaagtcaggagttcaagaccagcctggccaacatggtgaaaccccatctctcctaaaaatacaaaaaatgagccagctgtggtggcggtcgcctgtagtcccagctcctcgggaagctgaggcaggagaatcgcttgaacccagaggcggaggttgcagtgagccaagctcgcgccactgcactccagcctgggcaacagcatgagactctgtctcaaaaaaaaaaaagcaagttccctgatactgatacattctggtgctaggagatagaaaaatacaagtaattttttgagacagagtctcattctatctccgaggctggagtgccttggcaggatctcagctcactgcaacctctgtctcccaggttcaagcgattcttctgcctcagcctcccaagtagctgggactacaggcgcgggccaccacgcccggctaatttttgtatttttagtagcgacagggttttaccaagttggccaggctggtctcaaactcctgacctcaagtaatccacccaccttggccaccgaaagtgctgggattacaggcatgagccaccatgcccggccaagtaagttttttttaaggtacctggtaagtgctcgaaagaaaattcagcaagttaacaggggtagaaaaataactggtatgtgggaaaagaaaggggagactttagaatagggtgacaggaaaggaccctagagaagggtggggcatgtaagcctgaacctgaatgacaagaagaaatgcagaaaagcttcccatgtgaaggcacagactgcccagggcagaggctgggatgcaggaatgagcttggttgtggctggagcccagagattcccagcagagaatgataccaggcagactgggaaaataaagtgggcccaggttgcacagggcctgtaagcaacagtggagagactggattgcatctgaaatgcagtggaagacactggagggctttatgctatggagtgacacggtctgatttatatttagatgacttctccagtggctgtgtgccaatggtctaaaaaaatgcaacctcccccgactgccctccctgttcccaagtctctgtagagacttccaatccatttacttggacatagccattaagctctattgtgaagtcttttgaccctttataaaaggctcaccagtttcacttttcagtgatcctatggcagtctcctcttcccaattcagaaaacaatcagaaataatgtgtcgctttttaatgttttcagctgcccttctctgttcctacacagcaacctgccctacaaaatcaaatgactttttttctcccatttctcttccatagagcagtttaacacactttagaatttttacttaaaaagtaaagtacctgacattagttctcatttgcgttcctgaaaaacgcaaatggaaaaaatctgctttcatgtacaaagaaacggtcagcattacggatctctatggccacacttttcaatctgtgattccggaaaggctttctacactcacttaaaaaaaaaaaagaaaagaaaaaaaaatatttttaggtttctgaagttttgtagatcaaagccttttttgtttgaacattttaaactctgtaatgttagcagtgatactaatacccaatagtacactggaattcaggctattagaaaacagggcccttccaataattcaaacattctttctttcaggatttagaagccaaggcctgctgtgagtcaattgctggctatctttccaaattagcttttcagtcttagttatcttttacatttcatcccttagtcttcactccaggatttcctccattattgaagcaaggcttttaacaccccaacatgaagtcatttaactcctcagtgtttcttattagttacctaaatagatttgagactaccagtatttaaccctctgtcttaaaaatgcattataaaacgagacagtttgttatatggagggtgtagaacctgacacacacaataatgccaccttattctgcttctcaagtagaaaagtctattcccttcctggattgacctttctacatgccttggccaaaagaatgggacaaaagcaacgttgtgtgcgtctgaccctgagcctcaagaaacccaagaaacatcaggaagaagctctgcatggtcccttccacttgctgacctggggtcccctgccaccgctgtcagagatgtgtgaaccagagcaactttatcttgaaaaggggctgggtaaaatgaggctgagacctactgggctgcattctcagacggttagggcattctaagtcacaggatgagataggaggtccgcacaagatacaggtcataaagatcttgctgataaggcagcttgcagtaaagaagcctgctaaaacccaccaaaaccaagatggccatgagagtgacctctggtcgtcctcactgctacactttcaacagtgccatggcagtttacagatgccatggcaacatcaggaagttaccctacatggtctaaaaaggggaggcatgaataacccactccttgtttagcatatcatcaagaaataaccataaaaatgggcaaccagcagccctcagggctgctctgtctatggagttagccattctttcattcctttacttttcttaataaacttgctttcactttactctatggactcgccctcaattctttcttgtgcgagactcaagaaccctctcttggggtctggatcgggacccctttcctgtaacaccaccaccacacaaacgagcccagactagcctggtggaggatgaaagaccatggggagcagagatgaactagctaactgacccactgtagaccaatcattccccagaagacctgacagctggttgcagactcaagagtaagtccaatcatgatcatctaagctgggccaccaacagcagaaccaccaagttgagcccagctcaaactgctgatccagagaattgagataattaagtgggtactgggttaagctactaagtttagggatggtttggtatacatcaaaagctgacaatacaaaagtgtttaatattttcctcatgcactataaaacaaagataaataagtgtatgttttcttcagtacatttaccctactttaaatactcaggtaggtaacttggcttcttacggttacatctaaattaatttggtcttctggcagcaaccaactaataaaatcactagctttcagatctttaaagtaaggtacgttattctgtgatttagaatatcagaacttatttgtgcctcttggcccctttttccgattataaatattttctgccacatagctcagggacagcaaaattgtcctaaaatgtccttaaccactggctaaaaccatgaagcatgatgttcctttctggtgatataatggaagtgacgtatgtatctgagatgtcaactgatttcaccaagtacactgacaggtagtagttagcataattttagatgctattttccttaagcaggttctgccgggggataaatcccacaattcaagtagggttgatactttaaaagcagaaaagttttcactcaagcttcttaaaggaatgatattttgaacaatctgtctgtgctcctctggccggtttctaacagcatgttgtatgtgcctctccttaaacaggagctagtcaacttgactagttactagaatgtgtgaaaaagtgaggagacatgataactattgaaataaataaatgaattttgcaaggctgctaaatacaagatcaatataagaaaccaactgtattcagaataattaggtatttcttaaatgtgctatttatagcagcatcaaaaatataaaacactaaaaatgtaacaaaagttcacaagatttctatgcagaaaattagatagcatgatcaataaattaaagaagacttaaataaatggatgattatagtatgttcacagcttaaaagactcattattgtaggccaggcatggtggctcacgcctgtaatcccagcactttaggaggctgaggaggttggatcacctgaggtcaggagttcaagaccagccaagccaacgtggagaaacccggtctctactaaaaatacaaaaattagcctggcatggtggcacatgcctgtaatcccagctagtcaggaggctgaagcaggagaatcacttgaaatcgggaggcagagggtgcagtgagctgagatcgcaccactgcactccagcctgggtgacagagcgagactccatctcaaaaaaaagactcattcttataacgatgtcaatctttcccaagtttatctatgaattc

SEQ ID NO: 84 - DNA, 168323 bp, Homo sapiens
gaattcattatgcagggactggctagagaaggggtctgtatataatctcttaggcaaacaaagtgacttaattcaatatttgaggtgttaatagatcttctcacaattgtagtttaattgaacctgcccctgtcccaagtgacacgtggacaggaataacagagggtctacaaactggtcacaatacaatatggattggccagtctcaactgacaagccacattcagggacaccgactgagtacttcagtaaagcattaggtgctttggggaatgcactgatgaacaatggctggcaggagtaccctcgatctcctatgacaggcctcatgataaataccaatactgtgaaagaactgttccttctcggacactaaaatatatagaccatgcattcccatggaaatatctaataatctggaaagaagtgtacatttccctcaaatactatagacttgcataagcttaagtcctgtcacttgtgtagcaaataaattcctttctgattcacgaattcaactgtgactccaatcagttttagggaagaaggaaggcaggaataaaagttagcagacatcaaatatctaccttatcctgggatcacacagagatatctaatttaataaatgctggaatccagtgtggttcatattctcatctccatttcacaaataaagaaattgaaagcattcagggaggttaaagtggcttgttaaagctcacaccttagaaaactagaggtgtaaagtcagagattcacagccttgtgtttccgttgttcttcaacttgattttcgaaagtatggaagaaaacttcaacgatatctaatgtaaacagatgttcttatttctttagaaaagaagggttcacaagaagttgggtgttaacagcaggactggaaatttggcttggtgtacctagaaattaatcctaccctaacaagcaaacctaacatctcttcttaggcttttcacttttaaaacaacaatgatacgtgtaagaaatgaatgcatggccgggcacagtggcttacgcctgtaatcccagcactttgggaggccgaggagggcagatcataaggtcaggagtctgtccaatatggcgaaacgccatctctactaaaaatacaaaacttagctgggcatggtggcatgtgcctgtagtcccaactagtcaggaggctgaggcaggagaatcacttgaacccgggaggcagaggttgcagtgagctgagattgcgccactgcactccagcctaggtgacacagcaagagtccgtcctaaaaacaaaaaaagaaagaaaagcattaggtcatccctagttgttgtttgtttgtttgtttaatttgtgttttttatcaaaggaatgcatgtaccaagtttaatgtcaagtaatgcttaaaaaaaaaaagcttcccctcttccaaacttcacttctgctctccataggaagcacttctacctcttttagattttctgctactcactgtaatattgctacatagcatggtttactgctctatttttgatttattttattttagaacattatttattgagaagattgtgaataaaaatttaggttgccaacaccacacatacatgcacacgctttatctacctctatatttaaatattaattcattaagataaatttttgagacgtatcatatactcagcactaccataggcaatttgggaatacagtggtggccataatagaccaagttcttatcctcatgaagcttatattttaatgagagagacagacaaaaacaaacaaacgtatactatcagacagataacagctagggtgaaaaaggcagggtaaggggatacagaatggcagacagaaagtgatggtttcggtaggataatttttgtttaaatcaaatttcaatgtttaaattattttgactgtagatttattttacactgagccatatgcatgatgactacatttcttgtacaatttttgttttctttggaattaatccttgccttggcaagagagttgggtggggcgttggtttgcctctctttctattactgaatcatcagcagagtctcttccagggtataaaaacacttctcacaaggacccagcaagcaagaaacctaccagttccacatgttgcctcctgctcgcccagattgtcattttgccgctttcctccatcatcatcttgagaaatctttttgcctctctcatgtgccagatcccctctttctttatctcatcttcctctcttagtttagtccctccctttgatgggacacatctcctccagcagtttcctaagaaaaggtgcatgggtggcaattttattctgcatattttgcttgaaaacatctttattctaccttcacacttgagcgttaatttctgtgggtgaagtatcttaaattgaaaaatattcttctttagaattttggagacattgctctgttatcttctagcttctaatgttgcgcttgagaagtcaaatgccattttgaatttttaatcttttccgtgcagactttttttttttttcttcactaagacttttaagatggtttccttatcactggttctgcaatgttggaacagggtgcctggatgtaaatacgtcatcaccaggtcctaggtactcaaaatctgaaattcaggtccaattctgcaacatttcccttgtatgatgtttcccctcttctgttttgttttgttttgtctctctttctagaatgcttatttgtcagccattggttctcctgagttgattcctcaaattcattgtctctctctttcttccttctttgttctctttttgggaaattttctcaactttatatttcaccttttatattgaattttccccatatttttaattttttaggaaagttgtaagatttgtatagtaaacacgctcttacttttgaattttaaatgttcccttattaatttttaattttcaatatatttttatagttctctgggtatttctacatatagcatcctggtattccttcatggatgaaacattttctcttatctctgaggaatttttttccagctttcttctactctttgtctctgcttcttcaaggctgcttatgtttttctccttggttttcaactctttagtgttaggcactttcttcaaaggtctgctgatccttggctatttgttcacattaacagtaaagaatggctgcagagatatagtattttcccatgcttctggaaatcatccaaaaataacaaaaagaacaggaaatattgaaaacaacaaatttcaaaatattgaaattttttgtaaaattaggcagcagactccaaaatattttcaaaggcagccaaaatagctgactttgcactaaaacctcctaaagataagtagaaacaagcagaggagaaatttcagtggaaagcaaatccaccaaaataggtcctaagaactggccacagaaaatattatctcctgatggtaagcagaacatgctgaggggccaaaactatattccttgatttccagagggtctggaagttgggatgagcaagataagaacaggatcctccctcctcagcccttttttttttttttttttttttttttttgagacggagtctcgctctgttgcccaggccgagtgcagtggcgcaatctcggctcactgcaagctctgcctcccgggttcacgccactctcctgcctcagcctctcgagtagctgggactacaggcgcccgccaccgcgcccggctaattttttgtatttttattagagatggggtttcaccatgttggccaagatgttctcgatctcctgacctcgtgatctgcccacctcggcctcccaaagtgctgggattacaggcgtgagccaccacgcccggccagacctcagcccattttttaaagagaggcaggggaggcaggactatctgaagtgtcacagaaaaatcctattttgaaggaatcaaactatctcgctgataactgagaatgtgagagccttttgttagaaaaacctactagcctggaaagctgcaaagctgccgtggttcttccacattcctgcaaattactggtctgggaaagcaaactcattcaaagacaaatacatatgtatatacatctctccaaactaaatatgtatgtgtgtatatatatatacacacacacatatatatataaacacacagagaaaatattatatcaaaaaattagaaaaagaaaagcaaaatttattaacatttaaaaattccccccaaaaaatggtgccatggagaagctgagaattctaaacatcctaacccagtttgagacagtaatcttggcttcatctgctttttggaatcaaactttcctacaggtgagctgtccctaggacttgaccgggagccaaagaattgggcaaggaatagtaagaagctcttttggtcacagatttaaagctgtgatctccaatcagcttatccaaactgaaaactgacattctgatgcccacttatcattttcgtatgccttatttctcagttaatttggatgcaggaaaataaagttggctatttgttgtatgtaactaaataagaaagcttaatgtgtaatgtaataatattggagggctgccccaataaggaatagtctttcttgctccttatgacatgagtaagactgaaccctgtttaagtcctgccactgctctggtctgtatcctgtttgacagaatgagatgctgagaccctagctggcccttagctgcccccctccacctttgatatgcaatgtaatggcttagaacaggacactgatgacaacctcagccacctctgctgagacagaatggcccagtagactcttctgctgtcaaaggtagggggttgaggagacaggggcactgtgtactatttcttctctctttgtccattggacccaaatacatatgtttgtttcatttttaaaagtctaatgctaagactggtcaatcccattgattcctgcatgtgagtatagaaggactgagatgagaagcgtttactactacgttcccagtattgcccagtagtattccttaatgatcagtcctggcaccagtattataggagcaacaagaaaaagatttttgaaaataacttgatatttacagaaaaaagtattaatatcttctttgtaggaaaagtaagacatttgttttattttgaaagacttatgagtagaatatcatactcattttagtgagtatggcctgaaaagatcacaatcaaagtagcctatatttccccttgtctgtaattcctctagctaaaccagggagccaattttaacagcttgatagttctgcttctgataacaaatgggggaggaaatggcactgtgatttatatattccagccctatgtaagtgaattagtgtgagttagccttcttaagtcaagaagcactttctgagtggatgtctgaaggcagaccctacctagacaattggtggtatcaccaaagcaaaggctcccgaagaccctccaatcttgatgcctagtttccactcaaacaggacctcttattgtacaatggcagggagaaccatttcatgattctctgtgtaaaagggactttgaatacttaccttgtaactggtgccccgtgaagttaccacaaatgggtgttaacagttgtaatccttttgttttaggaaggtggaagtgataatttaggtcctgaaagattttgattttagctaaaagaatactgggctgtgtatgggagaacagtttttaacaaactgtgcaaccgtgattaaataacttttcttggctgcagtgatcgcctttacagaatgagaaaactattagaggatcatgaactctaggagttagcgctaagctttatattctttactatacattttacaggtcattgctcatgatcccactatttgtcattttattaattccagggaggagcctcttcctggttcctgatgagaagcttctaccttctctctgcagggcttctaccatttatgtggttccatggcaaaaaaacaaaaacaaaaaacaaaaaacaaaaacaaaaaaaacaggcctagaggtagttagaccctggggctaaggtaggaactgaggcaaggaggtgttccgagaacagatgccagaggactaacaccaaacacctccttgggaaggaaagggctaattcaataattagtcaatggaaggcatgtgagagcattgcagaaaaacaatgatcagtgtactgggagagaaatgggaactaggctaggagagagtacagaaaggagcaggagaacacagttggtaccaatggagaggcttgcagcaggcattaggccttcccagcacgcagcctgctaacagctgcgttcacttaaaggggcaaggatggagatgctacattgcatggctctgtttccttaggacagtcccagagggataggatataaagaaaatgtcccagaggctgggaacagacagaacacccagacaagcaggcatgggggaagcgctggcccacattcctcccagctcagctgggtgctctgccttttcactgccctatgatcagtgtgaggaatgttgactgtcctgtgacactgtgcgggagagaggtctctacctccatgggtcccaccctgatgcaggcctttaaaacagggtctggcagaatgcatattccctccatccttctcatcctcaatactttggctcagtggccccaaaccaagtttctgcccctggctccccttcttcgagttacacctcacctgaactgcccaccttgctcccactggcacaatctctcgggtcagctcctatcagatcaaatggatgtgtttatttttatatgtatcatctctccaccaaccagattaaaaattccttgactgcaggaaaacttgtcttgtttaccgtaggatttctagcacccagcacatattagggagaaagcaatgatttgtggcatatggaaaggcatcagccttcatgctttgtgactcccctcttcttccttgctcaccagaatccgagaccccccagtatcactccagctcctcagttccctttgcctggaaaaatgaccagcatctttcccatttttctagtggaaacttagttaaataaaattattccagtatattaaggaacttgcacactggaagggcatctcatcatttggttaaccttccacagataaaggtatcggctttgtcagaccattgaccttgggggtcaggttacaaatcctctggaaaaaccccaaagggtaagtaagaaagtttttacaactttacagctggctgggctccatttccagagatctttaattaattgatttgaggaaaggccatagtgtttccattagttccctggattctaattagagccatggttaagaccctcaagacttagcagacctcggtctctgctgcggtgtctgagccacggggcaatggaagaagcacaatgggtctcaggtgagtctcctcagccttcaccatacactcagaccccatgagcgagcacacgccggagtaacctcggcgcagccaagaaaaggtacggactctctgagatccaagatccttaacctgaggtgtggcttcaactccactaaaacatattctgatccagcaatctctacaacttcatcacaaccctgaggggtgaaaatggaggcttcgtcattttatttgttcaaatttattctactaagtgatacaactggaaccaccaaccaggtatgtctgaccctaaaggctgtgcttagtcttttattaaagactgagctatatacaagctaaaccttcctaatatctttttagaaaactaactggtaaccaataggatcttctgagtcacagctgggccttcaagcatgcatgccagggccactgcctctgaaactcaaagtcaagtcagatctctcacaaagaaatccacatacctggaattttccttgtgggccagctctccctgtcttcaagcacggcccagaaggacctgccttgtgattaagcctggaagtgctgggcttgaagggacttggcaaccatttgtttccttaatgcccagctataagcaacagagtttatagttgcagatgaattttttctcttattgcaaatggctttgatttaataataacattttccaagccattggcccataatgaggattattgcctgtgggtatttaatacaggggaaaagaaatgggctcacttcactatgcaaatggctgccacaaaccctgcagcaggagggctcatgtaacctttttactacaacactgtctggggctgtggaaagatgcaggcagttaacgtctcttttcattgagccagagttcaaccaagtctcgatggataactttactgggaactggctttcaaaagccaaagtccactttattctggtgccctatgcagggtctgaaaagagttgttgagtttgcaagctaactcagaagagatggagccaaggcaaggatgggtggtgaagggggctaggatgggcagggaggtggagggggctgtgctgaattttgaagatgaggaaatgataaaacaatgccagatgcagaactagggctttctctaatgtgatctcacttaatccttttatcagctctgtgtggtagatatgcctatttgatgaggaaactaatgcttttgagatgcagaggaacttttctcagtgcaaaaataaaaagcagagcatgaattccaacgcaggtttgtctggcgtggaaacctatgatcttactgctgtgcggtgtggcctgtgtgcatctggctgtctgcttatggcaaggcagcctcaggcactcattggaagctttctgctgttctacataagcatctcctctttctgaaccctgaagttctcagcactcagggccagttgctcagctgtcctgtctcatgctcctacttggaatgggcttcctagcaggcctatgttccctaataggagtttgctgggggtttctgtcacctgaaggtactgaccggttaggcgttgtctaattctgtgtgaggagaggcagctccccactgtactggacagaatggcagagaggagtttgaggaaataagacacatttctaagtttctaagggagagctgccagctggttaaacctgtctccggtaactagctttctctgtggaggcagtggggtggtagtagtaattaggagtagagaggagggagttaggaagcaagaaagaggaaatggaaggcttgaggcctggggacacttcctctttatctagccatcactgaagggtctctgcctcggcctccaacttccaccccttgtgtgtttaccggttcacatttactttgtgggccaagaagtgtgtcaagcatgttatgtacattaactcacctgctcctatgttaatcctgggaggctgcccttattattatacccagtttgcagatgaggacattgagatagaggctgagtcacttgccccaggtcatgcagctgatcagtggcagagtcaggaccctagacagggggcctgactctcagtcaagctatccccaggctcgcagcactgcctgttgtgatggctgggttttctgaggccaagaaatcctgccaatatcccctcagtgttctacccagaccacgtccgcctcccttctctgtcagcgtcacgcacagcatctttgtctcagattgcttttgtcactggatctcagcattctgtagagttctaacctattttgtggttcctgaagtggttttgaagcgatatttaaaatgcaaaaagagaaattcaaaagcccccaagtgctgtcttaaaaaagattacaaaaacatcttctgagcttggtcacaagaaactgatggtagagtctgtgtaatctgttgacaacatggtagagcttttattttttaaaattcttcccctatgttgtgattcaattttatgaatgttttcagatagtgtcctttttatttatagtggtaataccacccttccaagtgcaaagtttttccatctgtccagttatctaataccctccggggccctaactgactttgagccctagcaggagtgctggcaaggtggtccatgctgaggtttggaaaggatatttgtccggtggccagaagtgtaaggagccagagggaaaatgtcaaatatgtcctgtgagtgttgaggactcatagcctagtagccaaagcagtcattgagtccaagagagcaaaggaaagtggtagaagaagaaggtatctagaacaggagatgaaggcaaagaaactgctagatattggaacagaacagtatatgcagaatgcaggcaaggagaccccacagccattgccctgtgtggagcatagaacgctctctcatttgtgcaagtcacatggtgtatgcatgtgtgcttatgtgtgacttaagtccagcttcaaacaacaaaaaatgtgacaaagtcaagctgttcagaactgtgtcagcaactggatagggaatgctgtctgctgctcacagctgaaccaggaagagggcagactgtgggccagaagcagcacctcttctacagccatgctgaggaattttccagttatccctccccagggtgtttactgcccgggaagaatgaaggtctgacaagttacagttgctgcaaagcccttcctaggcaagtttgatcagaagagtcaggaagtgttcctttcactttggaggaaggttgaataaaactgcccaggaggtgtcagtatctaaggctcacacgaacaaagagagggagcccgactttgcaatcaaattgggaaggggtttggcacacaattactcaaatgtcccaaaggccagagaggtctggagaaacaagggatgcatgtcaaaatcttacttctgaccttcaaatcccctcccaaattttattatcttctatttctgaagctcctttttatctgtcacatagtagtattacattaaattgtctgtattgctgtattacattaaattatctgtattgctggccgatgattgcaatttgccctattttctctcagtctacctcagtggcgtcttcttcatgcccgttaatctttttttatgtaaaaaagatttacatgtcagctggggccctttccccctagatttctagacctccttgattccatcccattatgtaacagaatccaaagtcctcccatgggtgtctagtgagtcctgagggcaagtgcccccactgaagagcattcatggtaaaaataataataataataataaaataaacatctcttcttgccaggccataaaataattagttggctcttaaaggtgtgagaaaatgtttcagatctctaacgtacagacttgatcaaaggagtttttccaacagcgtttctcttatttttcactcaagagaatatcaagtaataagatatttcctatcctgatttgtcaagcctctgctagggaggcttctgtctttgctttagaaattcaaacagtggaggcttatctctcctgtatcaggagggtgcagtattaacaggagcatgaagaagaggccattgcggtagaataagagaaaatacagcaaattgcaatcactggccagcaatacagacaaaaaggagttagtcgacatcaaagccgacagtgcaatatacagtcaaagctttagacaaaatggtctgcttccaaggtgagcagactccattttttaagagtcaagatgattaacaggagtgacatccaattataatctttccttgctatctgtgtctctgaaatgttgacttcatattttttaacagaaatattacaaaataatcaacacaaataatactccaggacaaaggaaaagattttttaaaataaactcatggaatatcttgtgtttttcttcttttcctttgttgtaagctacataagttactgtactgttctaagcttcaaaaacactagcaatgatttatgaagtccgtcatattttttcagattaagaaagggtttttatatagctgaggttcatggctatggactttgaggcaaggtttcttcaggcccttggcttctctgtctttggttttggtatctgtccatgttatctctaattctttcattttcaacctggggtaagaaatgtagatcattcataaatttccataagaaattttttcacataacaggaaacataatcttccaccacctgctaactcccttcatctctttttctctatatgaattgctgtcttggaattcttatttttttcctctctattcagttattggaggtttgccttgttcctgcaccaagctttagtacccactccctcaagacccacagaagcagcaagagtcctgtccttaatgtaacccttctcctagagggcagtcaagattataacagcaacatttgtgtattgcagtaagtttgctcctgcatctttcaacttcttgctcttttatttctgctttaaatgcaagtcctcttattgatcttcaagacctagaacctgccaggatggagaactgcacaccatcttgggtctttaattgaaaagtcatagcaagggtgagattacctggaataggaatctgccagagggatttagttgctatgccagcaagctatactgtgtcatttttgtcatgctgttactgcatcctgggtagaccgaaaagcctctcagttgtctttggagctaaacttttcttaattgaggggaaaaaaaggtttctcaatgcttatctgacacagctggatgcaagagggtgctaatggaccagcaactgcctcaaatacattttaattaagtgatttccaagaagccatgtgcaactgagataagactatgaaagaagtccagaagctggaaggaggttagagagacaacaaaaaagggtcaatgtgtaggtcttatggggagtaatgaagtcaggccttgaagggccggtgtctttcaaaaaattctacccagggcttgctttttcttttctatcctacaggcttggtagaagtgaaaattgctactcatttatgcaagcagtagagagtagctgcgtgctatgaaccaggataattcatttattacaaaccaacatatattgagctattctatggacaagtcctatgttggacactgttacatgtgcaaggatgagtaagcccacccctaacctgtaggagcttccagtccagcagatagacagatgaccaactaactatagtacaagacataaattgaagtagataggaaaatagatacagtaatacagagcagggaataaccaaatatttcattattaccaagaaaatcagggaaacttaaaagaagtgatttttttttcaattcagctttaaggagtaaatacatttcaaaatgctcagaggggtgagaaggtaattcaagagagagctgtaaaagtatgaaagaaaataccttttgggggagggctaaggcgttaaatatacagaaacacaggttgtgcagaaggaccctaggagataaatttgaaaagatattttggaacttgatgaaggtcttaggagtttagactttttcctctgagcaatggaagagccatccaaggtgttaaggctgaacttgataagaactgtattacaataaatcacactggtagcagcatggatggaatgggattgtatcagaggcagagaggctagcatagtgtagaggctctcattctgcaagtaaaaaataaatcatctaagaattaatgaggatctgagctgaaattgtgattgtggggatgaagaggaagagagcaattgaaagtatatttttggaataaattggcagggctcaggaatgtggtagaatgaagaagataagagaattcttgcactctctggaaaagctttcagcacaaggagaatggagtttagctttccctatactggatgaccctcagtaataattaaggtatttgaatgttctgtccttaacacctgagcttgataaagaacctactttcagttctttgatctgtgtgtaacccagcaatgcctctcatccctagtgttcaaccgagtttatagtctttgccagagaaaagaaagcatcattagagaaacaggccaccagtttcttctcctgacacttggatacttcacaatgtgagttaaatgattacttacatgcagtgattttacgtggtacaaaattaattttacatagctcacataaaaatgggtggtgggcatacagaatagggaaagcagagatgggaaggcggaggggaacatgctctcttgtttaatggatagttctggtaggcagaggaagtatccaatttggaccatcagccaagcctaaaatatcctcctgcccagcacctggcctctttggctcttttcaactgtttttggaaattttggaaacataatttggctggtatgtttgttgtagagctctgcctagggtcaggtcccagccatcatcactggctgaaacagaatgtgaaaggataatacccacagtgaaaaatatcatcagggactttcatgacaggttttagctttttttttttctttgagaataagtaaaagcaagaaataataactttatggactcagcccacacagcacataatcagctagagaaaggccatccttggaaatgcatagatgttatttaatttttgtgtttaatttagagggatctcaaggaaaacgaaggtatgtcaggatggagaacagcacaccatcttgggtctttgattgaaaagtcatagcaagggtgagattacctggagtaggaatctgctaaggaggacattctatcaaaggatcagtttacctgaaaaatctccttactgattaaaattcttcttattccctactttctatgtccttctctaagcatcacatctctagatgagtgccatttttcaaattcagtgtgcataagtgtcatctgcagaactcaatataaacctcaaagattctgactcagttgatgtagagttgggtccaggaacttgaatttttaacaagcacactaagtgaatctgctccttctttgcagttccttgccctctatttggaagctcatggtgtttacattataaattcctcttttctggcatctgactttccctgtgatggagaacagggagtctgaataggaaagcacagcctgccatgagtacattttcaggctcgttaagtctcatattcatttgccgcaaggaatgagaaaagaagagagagcaactaaagactgcatgtttcaaacatgggtgatcatcatttctcctggggtaacaggctccccttggagaaagaaattacaaattactaatagatcatatggcagaaaattgcaaattccaagcaaaataaatatattcttccatttctagagttttaaattggctataaggtaggagggtgcagtattaataggcagctatcaaatagaacagtggtgttaaattacataatcaatttaatgttctgggtcagttgacaaagaaatctgttctctcactgccactaatttagagctttcaatatcccattcacaagtctttttaaaaaacttttgggaaagattttggtatatcaaattcttccataaacatctgtaacagctgtgtcagggatcccagactagctgacctttctccttttgcagtctgagggtggaaatgagaacataatcgcccatgatgagctggctgagcaaagttgggccaagccatcaaatgcagctgttgacttcccacaggattgatctctcttgcctcacagttcacttcaggaggaaggtgtgtagaatatgaggccacatgtcctgtgtgagtgtgcatgtgtgtgtgaatacaagcacacatgttcatatccacatgcatccagggtgagggggatgacagggatacagaaatttaaagtacacattatttaactttggagctaaagttttttttattggaaagccttctggctcttttgctctagacagtggtgaaaatgtgaagttccttctcaagtagctctagcaagtaagctttatctcacgtgccaactgattggtaagtggttctctgaagccctgttttgagaaggattctgagaaggaatcaggcttagccagaaggattgattgttggtgcatcctattattccagagtggaacatggaggtgtacattgcaaccttggggaaggttgtacctacatgcttcaagcaaatgccatcatttaaagagtaggactggataagcacaagtctttaggacatagtgttcattctggtgcccatgctcaaaatagctagatgttactcagcacatccattattcaactatttatttagtgtatattaactaccaggcactgtgctatcccctggaactacagaggaaaacaggagagccaaaactgagagctgagccacagccaaaagctgagtaagccaacaaccagtgaggtcacatcaggtctctgatgggtttaatgtagtaaaatccaccccctgagtaagcatatagacagaaaaatcattgattattaaatacatctttgtttaatgaaagtctgcatgtatgtttgttaatatacacgaatgaattaaaatacctgcaatggaatcaaaagtgggcatggctgtgatgtcctcagatatcctgtccagtttgggctcaggtccaataatgtgaactaaaaagatcttaaccattgcaattcatcattctgaaaggcttaggggcagaaaattccatttgctgctttgatcatattttcaattccaaaagtttcccaagtgaaacaaggcatagttggttcaacaaggagaatggtataatgatattgcagttagcagttaggtttaggagaaaaaaaaaatcaaaagtttttgtaaggttaaagacttttggggaaaaattcactcctacaatatgcttgtttgttcagtatctaattcttcacagtcctgttggcagggcatcaaaggagtggccctatggtcttctcaggcattctgatggtgcaggcaatattgattacttttctatttgaaagatagggaaaatgtgaaaaccaagaccacttccttctgctcttcaccataaattggtatatacacagacagcagtcattaattggctgaatctgacagatttaataatttaattctgctgcaaaaacaattattcaacttttttctgatttgttttttcttttagtttcctcctgctttatattatatatacttcagctcttctctgctaacacatatttaaaagactattttattttggaggcttaagtgcataacaatggtcccccagtcacatgcttagttgccatagaaatagcttctgtgtgttgactatctccatacatcaggtactatggtaggcaggttagaagaaaagttgttcgcaacttcatcagaaactttttgcataatttaattcacagtgttctctgggaggaaaattttattcccaataaaatgtttaaggaattttctcatgtgctttaagggtaatcagttgtctacccagttgactgtcagctgcccatcagttaagactctagtgactttttttgaaagatgttatttttcagaacagttttaggttcacagcaaaactgagggaaagatacagagatttcccatatactccctgaccctacacatgcacagcctcccccattatcaatatctctgaccagagtggtatgtttgtcatagttgacaaaggtacattgacacattattacccaaagtccatgtttacattagtgttcactcctggtgttgtacattctgtgggttggacaaatgcataatgacatgtatttacctttgtagtatcacacagaattgtttcagtgccctaaaagtcttctgtgcctgccaagccatctttccctctcccttagcccaaccattactaactgtcttcatatttttgccttttccagaatttcgtatagttggaatcatacagtatgtagcctttttagattggcttctttaacttagtaatatgtgtttataggttctctatgtcttctcatggtttgatagctcatttctttttagcactaaataatattctattgtctggatgtaccaccatctattcacctactgggagacatcttagttgcgtccatgttttggcaattatgattaaagctgctgtaaatatctgtgtacaggttttcctgtagacatatgttttcaactccttggagtaaataccaggaaatgtgattacttgatcttatggtaagagtatatttagttttgtaagaaaccattaaactgtcctctaaagtgtcagtatcattttggattcctaccagcaatgaatgagagttcctgttgttctacatgcatgctcaccatcatttggtgttttcagtgttctgcacttcggtcattctaataggtgtgtagcagcatctcattgtttttatttgccctggtgacatataatgaaaagcatattttcatatacttatttgccatcttttatattctttggtgagctgtatgttaaggtctttggctaatttttattatccgttgtttgttttattctgttttactgttgatttttgaaggttctttgtacattttggttaatggtcttttatagaatgttttttgaaaatattttcccccagtctgcgcctttaaaaagaaattatcttgacaatgtctttcacagagtagaaaattttaataaagtccagtttatcaattttttctttcacagtccatacctttggagtcttatctacaaagtcattgccaaacctaaggtcatctagattttctcctaggttttcttcttggaattttacagttttttatcatttacattctggtctatgattcatttttagttaatttttgtgaagggtgtaagatctgtatctaaatggatttttttaatgttgtttttatttgcacgtaaatacccaattgttccagcaccatttggtgaagagactgtattttcttcactgtattacctttattcctttgccaaagatcagttgactacatttatatgggtctgttgctgagctctctattctgttccatcaatctatttgtctattcttataccaataccataccatcttgattattatgggtttatagtaagctttgaagtctacttgtgtcacttttccaactttgttcttctcctttagtattgtgttggctattcttgaacttttgcttctacaaataaactttggaatcagtgtgtcaatattcacaaaataactttctgggattttaattgggattgcattgagtctacagatcaagttgggaagaaccgacatcttaaaaatattgagtcttctggccgggcgaggtggctcacgcctgtaatcctagcactttgggaggccgaggtgggtggatcacgagatcaagagatcgagaccatcctggccaacatggtgaaaccctgtctctactaaaaatacaaaaattagccgggcgtggtggtgtgtgcctgtagtcccagctactcgggaggctgaggcaggagaattgcttgaacccaggaggcagaggttgcagtgagctgagatcttgccactgcactccagcctggcgacagagtgagactccatctcaaaaaacaaaaaacaaaacaacaacaacaacaacaaaaattgagtcttcttatccatgaacatgggacatatctccatttattcttaaatttctttcatcagagttttgtagttttcctcatatagaccttgtgcatattttattagacttatatgagaggacttcaaatttttggttgctaatgtaaatagtatagtgctttaaatttcaaattcctcttgttcattgctgttatattggaaagcaattgacttttgtatattaaccttgaatattctacaagattgttataactgcttattagttctaggagttttcttgttaatttttttagattttctacatatacagttatgtcgtctgtaaataaataatcttaatttttttcttcccagttggtatctcatttatttcatttcttattgcattagcttagattaccagtactatattgaaaagcagtgagaagaaatattcttgccttttccctgatcttactgggaaagtttcaagtttttcactaatagtgaaaatgttagtgtatagcatgatgttagctgtgggttttttgtagatattctttatcaggttgaggaagttggcctttattcctgtttactgagagtttttactatgaagaggtgtttggttttgttaaatgctttttctacatctattgatacaatcatgtggtatttcctctttaacatgttgatgtaagttacattaatttattttcaaatgctgagccaggtttgcatactgggataaattccacttggctgtggtatataattctccttatacattgttcgatttgatttgctaatatttcattgagggtgtttgcacctgtctcatgagagatattggtgtatagttttctttccttgtgatggcattgtctgccattgcaataatttctttttaaaggcacagactaggggaaaatattttcaaaaaacttattctataaaataccattaaccaaaatatacaaagaacattcaaaacccacttctgggcctggtgctttctgttttggaaggtattgattattgattcaatttttaaaatataggcctatttcttcctgtgtgagttttgacagattgtgtctttaaagaaatcagtctatttcctgtagtttcaaatgtgtgggtgtagagttattcatagtattcttttattatccttttaatatttatggggtctctagtgaagtcccctctttaatttctgatattagtattttgtgtcttctccaatttttttcttagcctggctacaggcctatcagtattattaatcttttccaagaaccagcttttgttttcattcattttccctattgacttcctgtcttcaatttcattgatttccgctctaatttttattatttatcttcttctacttgctttaggtttagtttacttttcttttcctagttttctaacatggaagcttagatgattgattttagatcttttttcttttatgatatatgcattcaacgctgtaaatttctaagcactgattttgctgctttccacaaattttgacaagtttttaaatttcatttagaccaaaatactttttaatttttcttgagattttgtattttgctcgtgtgttatttagaactgtgctgtttaatctctaagcattttgggattttccagctgtctttctgttactgatttctagtttaatcttattgtagtctaagagtagatgctgtgtaatttataatatttcaaatttgttaaggtgtgtttatggcccaaaatgtgctctatcttgttgaatattttgtgtgagcttgagaagaatgtgtattttgctgttgttggataaagtagtgtatagatgttcattatatccagttggttgatgttgttaaattcaactatattcttactgattttctgcccactggatttgtccattcctgataaaagagtgctgaagtctctaactataatagtggtttcacgtatttttctttgcagctatatcaattttgcctcacatattttgacactctgttgttaaagcctaatgactgttaacaaaatatttttgtctctttacatcttgcttaacagtgagtgtgtaactattcccttgtcgtataacatgttactactacaagacaatattcaaattgtcccaagaggaatatttttccccttgtgtgcaaatatgtagtagaaatgtgctcttaattgactgaatactttagctagagagactttatacacattgtctcttgtcttcttaacgtcctattgattatgttatctcatttacttacgggaaaagtaaggtctgggaagtttgctcagaaaaacatagctaataagtagatgaattcggttgaattcaaaaccctatttatgtgattctaaaatattttccaaaatgcatctccatctcttttggtgggttgatggtttgtgtattagtctggtctcacactgatgatacagacatatctaagactaggcaatttacaaaataaagaggtttattggatttacagttccatgtggctttggaggcctcacaatcgtggcggaaggtgaaagccatgtctcatgtggcggtggacaagagagcttgtgcacggaaattctcttatttaaaaccataaatctcattagactaatccgctatcaagagaacagcacaggaaagacttgcccccatgattcagttacctcccattgggtccctcccacaacacatgagaattcaagatgagatttgggtggagacacagccaaaccgtatcattcagcccctgactccccccaaatctcatgttctcacatttcaaaacaaatcatgccttcccaacagtaccccaaagtcataactcatttcagtgttaactcaaaagtccacagtccaaagtctaatctgagaaaagcaagttccttccacctatgagcctgtaaaatcaaaagcaagttagttatttcctagatacaatgggattacaggcattgggaaaatacagcccttccaaatgggagaaattggctgaaacaaaggggctacaggccccatgcaagtctgaaatccagcggggctgtcaaattttaaagctccaaaatgaacccctttgactccatgtctcacattcaggtagtgctgatgcaaaaggtgggtctccatggtcttgggcagctccacccctgaggctttgcagtgtacagcctccctcccagctgctttcacagcctgatattgagagtctgtagctttccaggcagacggagcgagatattggtggatctacattctggtgtctggaggatggtggccctcttctcatggctccactagatggtgccccagtagggacactgtgtgagggctccaaccccacatttcccttccacaccaccctaccagaggttttccatgaggaccctgcccctgtagcaaacttcttcctgggggctttcaggtgtttccatacagcctctgaaatctaggcagaggttttcaaactccaatccttgactgctgtgcactcataggctcaatgccacatggaagatgccaaggagtggggcttccaccctctgaagcaaaagcctgaactctaccttggctcctttcagcctggctggagtggctaggatgcagggcaccaagtccctaggctgtgcacagcatggggatcctgggcctggcccacaaaaccattttttcctcttagacctctgggccctgtgatgggaggggctgccatgaagacttctgagatgccctggagacattttccccattgtcttggggattaactttcagctccttgttacttatgcaaatttctgcagccagcttgaatttcttctcagaaaatgggattttcttttctaatgcattgttaggctgcagtttctaaacttttctgctctgcttcccttataaaactgaatgcctttaacagcacccaagtcacctcttgaatgctttgctgcttagaaatttctttggccagataccctaaatcatctctctcaagttcaaagttccacagatctctagggcagaggcaaaatgccgccagtctctttgctaaaacataacaagagtcacctttgctccagttcccagcaagttcttcatttccatctgagaccacctcagcctggaccttattgttcatattattatcagcatttttgtcaaagtcattcaacaagtctctaggaagtttcaaactttcccacgtttttctgtctttttctgagccctccaaactctttcaacttctgcctgttacccagttccaaagtcacttacacatttctaggtatcttttcagcagtgccccactcccagtactaatttactgtgttagtctgttctcacgctgctgataaagaaatacctgactggacaatttacaaaagaaagagttttattggacttacagttccacatggctggggaggcctcacaatcatggcagaaggtgaaaggcacatctcacatggcagcagacaagagaagagagcttgtgcagggaaagttcactttttaaaacaatgagatctcatgaggcttattcactaacacaagaacagcatgggaaagacctattcaattacctcctaccgggtccctcccacaacacgtgagaattcaagctgagatttgggtggggacacagccaaaccatatcaggttgtttattctaatttccttgggcattttgtgcttttcagatgtgcaaaggcctgcttcagtttctatagtaagtaggcctaaatggtaccatccatttcacatggcaacatgcatcagtatttctgatgtctgtgttctgggaggccacacacaggtgcttaccctaaaacatagagtctcttcctctctttgtatgaggaacacttatagctacagtctattgagtaaggtactctatctagattatgtccttgaaccctattacagaagataataatgtctactatattgtaaagtagatattatttccccttttatacagtggaggaaattgaatttcagagaattagattaatgtgcccatgcatacaaagctgctaaaagctgagccatatgcttttcttcagtgtatgaatgaagaaaagaaattttagtgtttttcccttttttcccgtttaacagcacctttaccattctgccttctgaagttaccacaatgatgccatttcttcagcaggtgaaagccttctttgtttttgttttgtattgttttaattgttttggattcattcaggtttgttgcatgagtatattatacagtcttggtgtttgggcttctgtggaacccatcacccaaatagaaaacatagtacccaataagtagtttttcaaccccttctcctcttctaccccatccccttctagagtccccagtatctatggtttccatttttatgtccatgtgtacctggattaattcatgtttataattttccaagagagaatgtggctgtcctttgaaccacacctctttcattccatctattttctgtctcttggaatacagcataaccatttctgaaaagttctccctcactttccaggagaaaggggggacatatttcaagagtttcaatacctattagaggaataacagcgattattaatcaggtggctgcaaagctctgtacaagatcatttttggtccatcaagttgtctctcatggcttcgtatgaacatggtacaggtgatagggtttgggggtggattcctgatggaaaggggaaccccggctcaaggctgaaaaatggacaggcagcctgatgggaaggctgactgatcaaacagttccactgagccccaggctggggagtctcctagttatgatgcatactctgtgctgtacttctgcttgaatttgaatgacagccttgggcaagcttccaaatctgtttcctcaccaataaaatgagggtcataatagcacttcccttatagaattgttagaagacgtaaatgagataaagcctctaaagcccttaacccagtgtcaaacaccaaataaatgctcagcagcaaacagagtgatcctatgccctgtgtatgtccagtgctattgtggtttatgcctattgtggcatactttttcactgtcagagcatcatgggttaggcaataaattatatggtcgtccaactgtcaaatgctatttattatattatatttgactgtaaaatatcatccattttcaatgtaagaaacccaaagattggtgagaggatgaagctagaacaactgtggttagctggatgctggccaggtcagagaaagtttctgtgaacagtcgttacgagcggcaaagatggtcagtaaatattctgtgttctgaagtgttctctctcttccttgcttctgaagtgaatctgaaggactccaatcagtggacataagaaacagtgacagaggctaaaggcagaagaggaaaagagtaatacatgtctacctgttctcttgcctccttgccaacaaagaacgaagtctgattaaggggaaagctaggggagttccctcaacttcctaaatgatgctcactccctgtctgcccctgttatttccctctcttttttattaaatctcatgtccacagtaaataatagtaaattttataatcctggttctcattttgttatctaaccagttaacctattgactttttgacttttagttcattctaaccttattcactcttgttttatctgtctgcctaggacaaaagtgatcattttccatgaagtgtaactacttttaagaattagaccaccttgttcttcaaatatttggaggacctcttactaagaccctagcaaggggaactctctgctcctgagggctctgctgtattgctgaataatccactgggccatcctagaatatactctattctaggagatgattccaaagtgaagctgtggtgctgcccctctcataacccctacaccctcagcactgctgcccctgcccacattgctcttccctgcctaggaatgggattcaagatgtatcctcacactcccttggcagtagcctgaatccagcataggatacttcattgagaaagctgggcaaccccttgtcccagaactgatcgagtggtgccattctgctcaaaaaatgaaggggatgccaggccacaaggggcagaggctcaagaagtctttttttttttcagcctacacagtggttcagaattcagaccacatgagctcaaagcccgactctactacttgctatttgtaagacatttagaagggtatttaaattctctatgccttcactttctcatctataaattgatgataataatcacatttactgatttttttaaaagattataggtgacaatgtatgtaaagtactcaggacagcacataatgttcaaaatattactatcaccgtcatgatttttaagttggagttagacttctttggagtataatccacatacctttaatggtttcattacatgactgatgtgttatatgtatattatatgtatatatgtaattgtgaatatagataccgcaaatatgtgtaattttttagtcatttagctaggtcctattctgccccagattttgagcaagtcattgaattttgttttttctttccctgtctttgcttattaatatatatgtacaacccttagaacaactctatgatacagaaattatcattctctttttttttttaataagtggcggaaggatgtttaggggagctaagtaacttgtccaaggttacatagccgatacatagcaagatttcaactgaggtagtctctctccagagattgtactattaataagaccatcagattcttcagaagaggtttcaactatatactaatatggataaaagaatagtaatttcttacatccttacaaacagctttccttttttcacttttttctttcttaaatttaaaatactttgattatgaatgtcaggactgacattgttgggtttatgttagacatctgaatgtaagagagcaagagtcaatgacttgctcaggtcctggaatatgggccttccctacaatcatagaccacagagatggactcttatttggagctcaatacatgtttgtggaatacatgaatgaattgtaagtcttgcatatttttcatcttttgatcagacattaccatatccatttgagaagtgaagaaattgagtcttacagaaggccagggtcttgctcacagtcataaaactaattaataaaagaaacaggattagactccaatcccacttgcttccaatcctgcactgataccctcttatcgtcttggtcctgctacgtacaaaccagagcacagacaaacctgggaaggaaatcgttctcagaactgcaattccatccagattgctcctctctttggaggctgcttcccccctcctttataagtttttcttttctggatgactgtccacactccatagcaggcaagccgatgctccccagtaatgtcagctgaggtctggtgcctccattatgtttgattaggcaagtttcttgttctgtgacaatctgcagagaacacacataataaatcagaagtctatggaaagtttaggaatgaaagacatctcttgcagacctgaggagctgagagctcatttttgagaccctgcaggaaacaaaacaaaacaaaacaaagctgcggccttaaaaaacacatttcctttgctttcagaggaacttgtctgtaccatttttttgccacttaatatattctcctttttactggctgagttccaaaagggtggacctccattcaggacccaggctgaggaaatagaaaaaaaaatacaagaagctgggatacaaggaagctaactaagctggacagtcagtgtaggatatcaactgtgtgaatttcagcatcacatgcctaggttcaaatcccaatttctccaccagccagtatatgggaagcttcactgtagaagtttagtttcatgtatcttattaccaactggtaaaatcctaggtcttgaggtcctgtggtggttgaaaaggcaggatgaagagatgggtacatggtatcacaaaactaacattcatgctgtacttttcttattctgagcacttgctcagcacctatgaagtattagattacagtattttattctttccatttaccagattcttaggagtcctccaaagggcccagggttcctagacccagggttcttctttactctttgccatgatacttattttgcaataatcctgtcctaactgcctaagttgaatatcctggacttaaggtttagcaacaaaaggaaagttgatttctgatggaacacaagaacattttagaaaggagaaatcttttctcctaaaggaaaccgtgaatgaaactgaaagaaacttcacctttgctaattataatcttgatatgcccaggctttactagcatgtgatgagagatgttatcacataaatattacacctggattttgctagcttgaagcctgaacgtaatgatcgcttacaaagtgccccaggatatttaagtcctcacagtctctacacctgccacagaagggtctatgtggacaagtaaaattgtgctacagccagcactgagtttgtctttggcaggttcaggtggcatccctgagtatagattctcactaattactctagtcactggccctaatttttcatagtgcagaggcagtcgggggttattcaaaaagagggaggttgcaacctctaggttatgctcggtcatgcatagttgcttagtattttagagtttactgaaatcattcttctaaattacacacacttagccaattttttgcccgagcacacaaacaccatccaggtgatggtattgggctggattcaagttctgtattacctggaacactactggcctcaagccactgctagattattgagtctgcctcaatatatcacagttttttttcttcatgatggcttttggggggcttttagtagactctggaataaattggcttctagtacatcctctcattcctgtaggttttcagtgcacagatgggatctgagagggaaacagttgtgaagcagccccaagggatggtgctcccaatggctgcagcattatataactggaatgacacagggcacaacttacacatacttagtgcccctttccctaattatttctgtcagacaatgttatggactgaattgaagcccctcagaatgcatatgttgatgccccaactctcagtatctcaaagtgtgattgtctttagagacagggtctttaaatatgtgtttgagttaaaatgaggccgttaagatggagtcctaattcaatgtgactggtgtccttgtaagaagagagtgaaacagcaggggcacatgtgcacagaaatgcctttgtgagaacaatgcagtgagaagcctgccatttacaaaccaaggccacaggcctgaaacagatcctgccattacggcactcagaaaaaaacaattctactagcatgttgattttggacctccaacctccagcagtgtagggaaataaatttctttttgtttacaccactcagtttttgctaatgtcaagcttggagaatgattacaggccactttaatccacctccaataaataaaccaagcatgaacagattttgcaaatgtagcttccaaactaatacattacatctcaggtccaatcagattgctgcctaaccccagacccacctgccataatactctcctataagagactttcactatctttttaattacctccagaaatagctacccagatcatgcctagttactagaggcatattgcatggctctgaacaaaagctatattcctcctccaacttgggacactctatctcttccctatggggtcattcttgtatcctaagctagtgccttttattaggcatccaaggtctatgcagttcctctactgtagtgatactacacataccactagttgtgatatgtgttcaggctcccaaaccagacaaatgtaaccctgatatttactagttgcataatcttagggttgtcatttatcttttcaaaacttaagttttctcatctgcaaagggcatgatagttgtcttagtcagtttgagctgagtaccatagattgagtggcttaataacaacataaatttatttctcacagttctgaaggctgggaagtctgagcagagcatcagcatggtctgttctagtgagagtcctcttccaggttgcagacacagtcttattgctgtgtcctccttggtggaagagaggtagctagttctcaacctcttataaggacactaatcccatttatgagagttccaccctcatgacctaattacccccttgaaagccccacctcctaatattatcacattgggattagggtttcaacatatgaatttgggggacacaaacattcattccactgcaatagtagacactttgttgggctcttacaaaatcattcatataaaattcttggtttagtgcatggctcatggtaatcattcaacaattgctcaggtgggaggttgatcatattattgttagtgttggaacctgctgttctcatcttctaacattatctgattcactttcattgacggcctcagcattctttcagtatataaaataatttctctgttgtggggtattttctcaccagtctttattttgttattagtcgccatagaggtaaaatcgatgttttccacaacactctaaatttatagggctgggagagccactttccattcccctcagaagacacaggatgaggcagagtaggcgtgggagaaacctatttttctcttggcaattgcctctaggacacattctttatttaagaataagaacctttaacaataaccctgagtcacaagtatcacacacggcagacactacatttacaaaaacacctcagtgaaggctgtataaaaacctaaagtttgtgcatctcatatgatcttttttatcagtttcatggctgacacacgagttttctctgaagaggtgtacgcttttcacagtcactcagtatttttaaaaaaggaaattaaagcatttaaagaacatgaactatatgctgtgctatgtgccattgatttctcacagcagacttttaagttattttgtttccacgctacatatgagaaaaattgagactctgaagagctaaacaacttaaccaaggtcatagactggtttatttaattttaaataatctattctggaatttttatgaacaccatgaaatttaccctatattaaacagtgattaggtagagggaaaagagggagttttcttggtctacaaagagaatattatcatttaaaaatatatatcaacaccattgaaaaacaaaaattatctctaatcctaccacctagagatcatcacttcccacattttcatcaattaaacaataattgtgatttgtataggaaactttcaatcgttcatatcaatgcaagggagagaaaagggtggagaatctaaaaatcatttctgtctgcattgcgtgcttttgggagtagaaaattaacctttttgatcatgttctgcgtgggctaatgactaaaattgcttttcctttcccaactgatcccaattcagggcagagtctcagaagcattttgctgacaagggattaaaacgtgctgcggctaattcaagaagtggaaactcctcacatggataattaagatctgactgcagaacaaaagcttgaacgttgttgtagactgggggctctccagcgtttcaaacactttatccgcagagccatcttgaaaggtagattccattcaatttgcctggcattcattgtgagactgacttactctgcagtgtgttaaatgtccaggaaacagtgtctgattataagggacaggcaatctagtgaaggaggctggtatgcataccactaactttaataatagtaacagtgatcattttagctaacatttattaagcaattactttccctaggtccagctctattctaagctccttaaatgtattaactcatttaatcctcatataaaggatagtggaaccagtggaaaacactattcatttagagaagaaatggtttatcctgaagtaggagcttagaagggcttcaagtactattgtcatagctagaagctcatatcctgactggaccatatttccaaatctgatattagcgatctctcgatagctgaggcacgtacacaggtggttcgggcaggagtccttctgctacatctgtttattccttttcctctcattaacagtgaccgcctggttcacaataagtccctctcctctaggaacagtctccccaacacatacagtggactccacttgccatgcctctgtgaccacatatggcactgcctctctggacatagctgattagaccaggcattggcaccaaatgaagctgggccatttagatactaatactggattatttccactaaaagtaaggggaaaacatcagtctttctctggtagtaggaactgaggaatgtggatgtttgagagctgttggtaactgtggtagccatgagaataggccactcagatctctgcttaggggagtgtaatgaacctgacctagagccccagtgctgactatgtgtccactgtctgttcacatggaggccacactgctctcagcctgtgactgggcgcagcatgagagggaagacagactatctgtgagacaggcaactttggctccaggactccccacaagcacagctgaaactttcttagaatagcatgcagcccaaactctacccatccaacattccttccttcctcctccccttcacaggggtcaggtgtgctcacagtgtggtacctctcactgtctcttctggttccctccccttattccctccttccccaacaaaagccatgcacatctgatcccatcttggcatctgcttctttgaagaagtgaattaatgtcaggactttctctttgtgtgatctttgatccttgggtactagacagtttcttcataaggtaatggtaatgttcgaagtatcacatttgcggatgtcaaattagccacccagccaagaccagagtctatggtggaggggattacacaaggttgtggatactcaaaagtgattcactggccatcatcagtataaacatctactgcagctactaccaagaaagttacctgcatttcccaaaaactgtaatttatagagaggtaattttatgtcctgtcttctggagaaaaaccacatgcaaatagatacacggaaatgacaaagattgttctggaaattatcataagtagaagtaatttttagaaaagaaactgtatttgtatctaagtggctcattgaaatatctctctggaggtagggctggtatttctaagtcttctttaatctttgggaacaaaatagagaaaggaggacaaactgaagctttggtaatgctgagttaattggtgtttttttcaatatgaaccatgctctgtgggcaatccttcattcagcaaatcacctgtgaggctatcccacaaaaagacagtggacagaagtgtagctaagttctactgttagtggaagtaaaggtgggaggaatagggagggccttgtgttgctgttcggtaggaaattgagcacatttaaaaaagtgttccttttttgggacctttcctatgaattacatagtcttggtctcacagtacttcttcatcttttaaaactggtcttagcattcattatgttgcttgaggaattgaaagtaagccactatttagagcaattgcaatagatccctttttctaaaaccactatccttctaatcgggggatgttacataaaaataggtggactgtgcagtaagaaaatttagtgatgagtctggattttcttacctgtcctcttgaactccattttaacaatgtgggatctccagttgaattatgtactatggccatcagtaacattgaggggatcatacagagtgttctgtagattgtgaagtactcgtttgtatatttttaatttttttattgaggcccaaagcaaatgaaaagagagaggttcattgatcctgtgctgggtaagagaaaaatgacaattcctccactctgaggtcttttgaagaaagttgagaaacagtgttgtatcttgaagcatttcaatgactcatactcttccatccaaagttcagaaatttatggacaacgcactgagtccatattctagattatcagaacaaagggagcaggttagacaagtaattacttctttcctcatttacactgcttcacatgtacttagcccccagggtccatttcctgaagttcacactatcagaaatgttctgtgttaacaccttaagtaggcacaatacaacctcacttggcgttagtattgattctagcctccaggtactttatcttgggggagaaaagtgtttcaatatttacctgtgttatgtaaccacacatatctgagaaagttagaattaatttctgtctgtgctgcatcagcacagaaagtaaattaaataaagacttttttattgaaaagaaagagtcagtttcttttctataaactgagttgattacctcaaggtttcataggtgtgggcaagttgggggcaactcaaaaactcaagctcgtctcctgggcagtcacaaagtttacaccagccataaaaatcccaaggcatttgtgtttaatgttaatgaggaagtggatcaggtgaatctacaaatctcaacaggtgacaaattacaaattaggctgagctgcttttggccccctggtgaaggagaacagggttgctgggagaaggtgctagctgatcctcacgtttgcttacaataatgtgataatgaagttcaacccaagaaaatcagatggagcagccctctgggaaggctgcctccttcttctttgctacattgtctttctaagaatgtcagctacaacttctcacaccctatatttcagaggccttcacaatctgttcccaacttgcatgaagccttttgcctttttattgcctatagggtaatgtgacttccagtagttatggtatctaaagcccttctcagatggttcccaaccctcttttcgcatcttctctctgacgactttacttgctccttctcttcagataggcaagcgactggactccgtagtattccacccatgccattattcttgcaatttcctctacccagaatattatcttgctgtttctctacctcatccaccaatgaattcatcattgtacagtgaagtcctcacttaacataggttcgtagaaacttggactttaagcaaaacaacataccgtaagttcttgaataatatcatttcattcaaggttgtttcattataaggttgatttttaaaaattggttttcttatattttgtttagcttaaagtcgcaatttccaagaacctattgatgatgttgagaacttattgtattcttcaagatacagcataatttcgactcaaattttctttctttcaccttccaacagatggaattaatacctcctcctcctactaatgccattctagcattttgcatagacctacccattataaagacttagacttataatcaaataaatttattcaacgtgatggtttttttttttaacctaaatcagaagttccttcaggactgggtccaaatccctttcagatacacaatgccaatttcagattgtctccccactcccaaacatgacattagggtgatagcttaaagatgtggaaccagtggcaggacctgaaagtcgtatcctaaattatccccaaggtaaaataagatgaaatttatttcatcttgaggttaaattttatatgtaaatttggctaggctatggtacccaattgtttggtcaaacactagcctagatattgctatagaggtattttatggtgatgatgaacatctacaatcagtgactttgagtaaaagagattaccttcgataatgtgggtgcaactcatccaaaagtgaaagcttgaagagcaaaaattgagatttactggagaagaaaaaattctactttcagacagtaacatagaattctcagtttccagcttgctgggctgctctacaaatttcacactcaagacttcaaaatcagttcctgcttgagtttccagcctccctctttgctctacagattgcagaattttcagcccctataatcacgtgagccaattccttaaagtaaatctctttatgtaaacacacacacacacacacacacacacacacacacacacacacacacaccttcttggctctatttctctgaaactctgactgaatatacaaaccaactagttagagtagaagctgaggtatgcagccaaagtgggcacgagaaactggaaagttaaggaataaagaatagcagagaaagtgataggcagaaatatataatgtccagaggtgaagtgcaaatgctcgtcaaggctttttatggctctgaggcttgtgcaagtcaatttggcaattcttatgacatagtacatatccattaaatgttgctgaataaactaaagaatgcatttatgaatgaattcatcaatactggccttctcttctcttcacaaaaacttgatagttggaaataacaagagtcaggatgtctaggacaattctgactcctggacaaagtaatcaccaatcaggctaagtgctctttatccctttcacagccacaagttgaacagtgaaataacaagcctacaccaaggtaaagtaataatgttttcctatttaaagttttaccatgttaagtgagatagctttctcagcataagggtgacgcagacaagcagaaaatggctgcctgctagtgccggcttctttagtttggctgttgaaatcatcatagaagctatcaagggctgggggcactcctttgctacacacatcatctttccagtaacatctgctcactgggccaaggatcaattatctctatagaggagatattgctgccagtcctcaaggcaaaaccctgcatgtgaggccagtcttggacaacatcccagaagcttgattttaccctctggacatcatttaatctcagtcaaagggttttgctctttgtccccaggtatatgcagaatgcacacctcagaggaagtgacagaacagattgtggcttttaaaagagtttgggtactgccatgaatggcaaggttctcttgactactatgtagctgtcatcagggtaggtatagcagtccagtctctcctctattgaggactgtattttgttgccaactagtagctcccactttatcttctattctttcattcaacaaacatttattgagcacctactgtgtgcaaggtgttactgagagaaaggaggctacagggaggaattatatgtaaaacttctactgctggcagaaacaccaagttattacattgcacagataatgtggcaagaaaaaagatatagattaatccataagaatttagggggacaaaaaaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaaaattagccgggcgcggtggcgggcgcctgtagtcccagctactcgggaggctgaggcaggagaatggcgtgaacccgggaagcggagcttgcagtgagccgagattgcgccactgcagtccgcagtcccgcctgggcgacagagcgagactccgtctcaaaaaaaaaaaaaaaaaaaaaaaaaaaaaaaggccaaataacttcaaatagggcagtttaacccaaacctctataagcatagaatcattttacagaggagcagtatgcacagataagatttcaagaggcattctttgggaaatgctgcaatcaagcttttggatgtattctttcccttgagagttttatatttatcaattatttcccaagctatatgccttggagcactagacttctacaagatattaatcacagttctatatggattctcaggtcaaataaatttgggattaagaaaagctgcatatttactccctcctctgccctttccaatagatttttaatcagtttttggtgtctcagcatttttcaggatgttgagagataacctattaacacgttaaaaattttaagatatccagcagaaaagaattctgattaggaaatatttaaatggagactcagcttggctttatggtggcatctaagatgagccttaaggggacagaaaggattgttgttgagaacaggcctttttatttgggcagagtatgttgtccttgctgtcatattctatggccacaggcctcttttgaaaactggcattgtctctgtatctttccttgtcatttcttcgggtgaagagcctgaggagaggcaccccatttccccctccacctcagcactgctgtgcagttccgagatttctctaaaatgactcccaggttctgggagttaatgcctgagagtttgaaatgcttcctttgtcactgccagttatatctccaagcagtaacttctcaggattgcttagtaagagttccacctgagctgaggaatggtgtgttttctattgatagagtttttaaatggggaaattcattcaagtggagctttttatggctttgctaggttaattgggaaattggtgacattgctactagtgttcttgaggatgaaacgacaaagaggaagattgcaagcaatctgagaggttgaagtcagctacatgagaaagcaagaaagagatgaggtcatctagttcaactattggagtgcagatcttaagatgtctattctgttggaaaacatagatacaggggggaaaggaagataatcgagaaggagagaaaggaaaggagattaaaaatttgactttctcatatgcttacccactccaggaatgggcaatctttactgcctcagtctgagaggtctctcttctctctagcctgtccttttgcagatctttattctctcatccccacatacacacagccctcatttatattctagcttttacccaaacttctagaaaattccctgttttttttttttttaagtcacccttttgttatctaactcagctctctaactttaaacagaaggtctgatccttgcatcgtaaggccaggatacaaacaaacaaaaacagcatttggccaatccctatttctttaatggtaaaaaatattaatttattttagggtttctttaagactattcaataataactcagttatttccagcttatgatttagttcgaatcagtccttccaaacccagttcctcctcagagtgtcctcatccagattctcatccagattcctaaaagcctttggcagcagcccagaaatgatgccagagagggattggtccacttcccggaggtcactgatgcaacatggtttttgccccttggaatgcccagtgcttgctccagaaggtagtgactggttgtcgttgttccttcggtactcccttaactccttgatattggtaatctttggtaaactgcagatatgtcctccttcagtccccagattggcagtctactcatatgttctgatgtagagtccttcctggcccagccaaggtaatccccaagaaggccctcaggctctctctcaacaaaagccttttctcatggtggtcttagcctcctctgatgccaagatatgcctgtcaccatctctgttgatctctgtcatcaccaaggcatatttgccaacttcaactctttaaaaaaacacacacacaaaagttccaacatttcataagggaagcagggcaccaatctgtttactctagaggcactcacatttcttggttattatctaccattcttctcaatttattttacttgtatgaaaaatgagcaagactcattcctgtacagcttcttcctctatgagctcctctgggtcagaaataaagtgatattttcttgttagcatctctggaaaaaatcacttttgacccgtactatgttggttctttttgaatttatatgcttagaatgtggcatttccgtgggggttgtctatactgcacatgcccctttgtttatatactatgtgaccaggggtctgcagctatgatgagtcagaccaaattaccctgccaatgcatactttgaaatagtattttgcctcatgtgtataactataaattgatacagttatatagtgtccctgcccaaatctcatgtcaaattgtaatccccattgttggaggtggagcctagtgggatcatgggagcagattcccccacttgatgctgttctcatgatagagttcttccaagatctggttgtttaaaagtgtgtggcaccttcttactctctctccctcttcctcttatcctggccatgtaagacatgcctacttccccttcaccttccaccatgtttgaaagttttctgaggtctccccagaagccatcatgcttcttgtacagccttcagaaccatgaatgaattaaacctcttctctttataaattacccagtctcaagtatttctttgtagcagtatgaaaacagactaacacagaaaaatggcactaggagtcgatcattgctataaagagacctgaaaatctgaaagcaactttggaacttagtaatgggcagaagttggaacagtttggagggctcagactttcatggggcctgtagccccttgcttttggccaatttcccccttctggaaaggagcatttactcaatgcctatactcccattgcatcttggaagtaactaacttgtttttgattttacagacttaaaggcagaagggactagcgtgatcacagatgagacttgggacttgggacttttgagttaatgctggaatgagttatgattttgggagactgctgggaaggtgtgattgcattttgaaatgtgagaaggacatgagatttgggaggggccggggcagaatgatatcgtttggaattgtgtccttgcccaaatcgcatgtctaactgcaatctcagtgttggaggtggggcctggtaggaggtgatgggatcatgggagcagattaccccatttggtgctgttctcatcataaagttcttacgagatccagttgtttaaaagtgtgtggcacctccctactctctccttcttcctcctgctctagccatgtaagacatgcctgcttccccttcaccttccaccatgattgaaagttttctgaggcctccgcagaagccattatgcttcctgtacagcctgtggaaccaagagccaattaaaccttttttctttataaattacccaatctcaagtatttctttatagcagccagagaacagactaatacaatagtctgagaacagactaatacaataactcagagatcctaattttgccaaccttcaggagctactctcctttaaattaaataattgaggaccaagacaggtggctatagactttatcatgtgattatgcctatgcatttatgagaacttcccagggaatattttcaattgtcacaaatattttttatttccatagacagcatcttactctggactgctactgttttttgaaatttccttctgctatctaccccaattgttgaaacaaagttgaaacagttcccttgctatttccccaaaatatatctaagaccagcttataatattaacaatacagaaggtaattacaaagaagaaaagaacattttaaactgaacactatagatcattgtaccccaaatcctcaagccatgctcctccacaccatcattctatagacgatgtgtcaccccagtctctaccatacaatatatttcaaaagctactctattctgcaagctgagctagaaatgtataatggctcaaatgtgatggacttttatttaccactcacataaagttcaaggtggatttttatacttggaaagtagatcttcatgcagcaattcagggatccagactctgccatcttcaaaagattgtttccaaggagactgtgctcatctgcatcaagccataggataatgaaggagcacagagggtcatatttgggagatctttatgaattgggcctggaacattactctttttcatcttccactggctagaattcagtcacatgaccatacctagttgcaagggaatttgggaaatgtagcttaagtgcacgcccaggaacaagagaaaatagacttggtggacctagcttaaccagtttcaaagggaaaaaccagttgatctcttctccattaagctgtcgctatcagataacacaataaatcaaagataataaatctccttacaaagaaagcgatccttttacaggattatatttatcatccattatggaataggaactttatatttggtcacctgagagccaaacagaatacctctttaaaaaacatctgccctaaaggtacattttgcttttgtctctagaataataaaaatatgtcagtttttagaaatagtgatatccaattttaggtaacgccatcataagtatatctatatgtataaataagcctaactttttactacttataattagaaggaagtaacttctgttttcttctgtggatgaaagaagcttttcattccctttataaataagtcttttagaactacaagcttattcttctgaaactgggatgcaggaataaagcagagacaagggtcataatgctctttgactagggagtaacttcaaggcatttatgtgtgcatagaacataaagttagcacaatcatttataacaaaatcatcacagaactgatgtgtacattacaacttagatgactaaattcaatttgctacaacaaacatattctaacaaatacaatttcttataaaaacatacagagagtcaatacaatatccaataacaaatatataaaacgtttttgcagtaattgtagcctcaaggttaaggattctattctataggaaataacaataaaacattatacttaaagaggagaatgttaagaagtctggtcatttttggcaaataaactgcctataaactcaatgtcacattgtccagatatagattatgtttagatgtacctttatcaggatattccctcagccagtgctttgcattctcaaaggtacttgtgtcatccatcttcttattctctaaagatttctcactaactgcaattacgatttctggtcaatgatatcaatacaaatggttttttataattgctgaatacaaaattaggggcttataattttctattttcatactttctttttagaaaatatcccaaaggtgtagctacttcaattattgagcaacatgctagaaacttgtcaaaaagccaaagttaggctatttattgccttcacctatccttatgtgtactctacaaatgtgttaaccctgctcagagtgtatgcgcagggttcatgtatgtgtgagtgaaaatgtgtgcatgtcttggctagtaaactagttaggactcttcattgcaagctatagaaattaactttgggtaacttaagcagaaaaataatttgtggggacatgtcatttggctctcagacagatgaaaagcctggggaacccaacttaccaaagaggccgagattaagggaggcaggttcctgggcctataaccaagatcataaagtaagaaaagtgtggttagggcaccagagccactactgctgtttgccactacttctatttttgctcctgtgacactgggcattgatcatgttggatgtacacagcagaaaatctatatcctgcttgacttagttaaggttatctaaccacaggcaagcttccagggtccaggaagagcccgtgtctaggctttttgactcctggcctttggaaggcaagtacctatctgccaaacctaagaggctcaatggtgggttaactaaaagcaaagacagcaaatggtcactataatgcattgtaatgtggagtccgactcaatttttgatgcctgactactgacagctttgaagcttcatcccttcattgtccctttgtgccctacatttggacaagcagataagaaagcctgggtgctcctgcctttgattcaaaccatgaagcccctgccatgaaaaactctcacctcagcgctaccttctaactataataaaaacccaggcagtcacttttccttgctcacttaagccatctcagacctgcttgagagtaatgccgtgctctcccacagacctcaattatgtaagtaataaaccttttaatactctcttggggtgtgtgtggtatcatcagtcacaacatctgaacaaaacctgggtgaaggtccttctgcctctacagatgaccataacatggattcaaaatatggtatattagagtgacttcctaaaattctgatgaatttttcacaggattcctttaaataataagcatccttaatgcattcaaaacatgatctacaattccaacagactttccagaacttaattctctgcatgatggaagtaaaggcaactccaaggtcaacaagccacatcccctcctcagccttttctgtctttcctctcctatttcctccttctcctacccctgctagatactgggattacaaagaaaagctccttgctcctgctcaatgtcccagtcacttactttagtttacccttcatgatcccttcctactccttccatcctgctctataactccctcttctccccaccccggcaccacccactgtacccaaccaccttccttaccagggagaagacaagaagggtttaatgccagaatcaaactatgtacaatgaacctctgaggaggaagacaggggtgattgctgggctgagcctgctgtttccttgccattctttctccaggtcctcagatgccatatcatcgtgggtgtgctgccgggtgggcatcccacctccagcccacagtgttcagtttcactttttagtgagctgtaatatctatttttcttgctttcttttcctatttattttgtaaaaatgtactgagttttattaaaatatacacccataagaaataaagagataagaaaaagagaaaaagaaacagaaagagagagaaatacagaaaagaaagaaaatattccaagtttttgagtgtgagaggagcctaagtgcccagctttgcctgatggatagatgagagagttttgaagctatctgaggcttattttcctgaatgaataggaatgagctcttcgtgtgaattgtaatttaacttatactctgaatgaaatgatttagagcatgtgaagatggaaggggccttaagtgaacatctagtccacccattcttaccccaactccccttgtaacagccttggccaatctagcattcttgatgaagtaaccaaccaacttctactggtacatctccagtgaaggttagttcttctttggatgcatctggcttataggaaatccttccatttttgcttcacttgagctcccaattctttttgggtcacccagaacagcccaatatatctttttatattcagaagccctgctttgaattatccagtatcttgtctgctcacctatgccctcccctttgcccagaaatatcaactgaagactgtaaagacacgtctgcatccatcctgcccactgactaaaagcatcaaacgaatacatagatgaccaaatatttcttccccgtgatgagctgtccatgtgtgctctttagccataatgattgtgataagggaaagccctttctgtgccattaagaactgatcatgtgatttatgctccagctccaataagcatgttgagtatattatgtgctgcctttactggcaaggaaagccagtttacttgcttcttctatagtaataaagcctcctttcttactctctgctgaaaaaagcgtctgaatgtgctttgggttctaaagcaccctatttatagccccattgtcaaatgatgtctattcattacaatgctggatttgcaggttatcattctgtgtctgtgaaggcaggcacagatgtatgcatggggcattcctggctgacacaggaaagggaagtcttaaggctgtctagtttctgggtatcttctgaggataggttggaaaatatcgtatgagtttaaataaaagtccttcttagtccataaagaatggagctgacattgaatcgacacacagaaaccaggtaggctgtgggtccacccagaggagtttttacaggtcaaagcctccttgttttattacagactctcatcttaacattagaacttgatatttatcacaggtgcacttctaaataaagtgttttaagaacaatccatgatttgttatttccttgattttatttgatttctctaaggagacattattctggaagcttgtagaaaatacattttgcaggaatctttcattttgtacaccttccagtgatctggtaagagaaaggaagaacttgagagaaaaggcctaacaagtatttatttggtgttggaatctattcttgaagaccaagagaggtaaaaagcaaagaagacaatttataacgtatcatctagatgcaaactggaaaatgcatggtggtacgctggcctgttggagataggagaattagatattgagaacctggtgacgaagtgagggtggactgagaggagacagagaggtgacatctatactggggcttgatgcttctggctatgaggattgatgacttgttcctgccttcaaacctttgtccttacttcctccactagaattccctcttcctagatttttgtctgttgaaatgctctcctttctttgtggttcatagtaatctggaatagaggtcatttgtgcacaagagaaacattttccttgagagattcaaatcctgaagttggatatttagtatgtcaaaagaaccgttctcacctcactctatgtattcccaataccatatcatattctgattgcatctctcttaaggttcttgtcatattcagctgtgtattagttatttctctcttattacgaagttattttaaggcaagtactgtatctaactcatcttttcatcctcagccaagcaaaaatgtctggtatatgggacccacccaattggtatcaattgtcagacttactgggctttttgagacacatctctgggtgctttttacagaagataatctgagtatttgaatgtggcaatgtttgcccttttgacaggctttgaaaggttaagacaattgctcaagtatgtagttattaagttgaggagccgagatatacatcctgattgctctactctaaatcccatgtcccctagacagaactatcttttgaaggttaaacagtttcatagagttccacctggccttgtttaacttaactttgaattttgttcctgtttggtgaactgagcccaacgtgtttcagatgggtgttgtctcaacttattaacgacaaaggtatatattttaatgataaaactttttatgttcccatttgaaactttgagctatcatagtcctagaatctagatatcaatgatctctttgagtccttctgatctttttcacatgagaaaatgaggctgagaaattatgtgaccttcccagattacaaagcgagtggcagaactgagattagatcctagacctctgggtttatattttgtagatcttaccatttcagcaaactaggtcccccattactgtgcagtcttcactgccacctttagtgaatgtccttcagcaagttatatgatctttttgtgccagagttctaattagtgcaccaagaaggttgcagtggtccacttctcagggatattgtgaggacaataattaatagctataaaacattctgcaatatgcagcagtatacaaacaccaacatggcacaaccaaatctatttcacagtaattaactttatatccaataaggaagaaatcagtagagcaattcctacatgacttggcagaaatgcctattgtctctgtatcttaagaaagtggccgacagccagaaaagagaatcaaactgtgcttgcgaatttatcacaagatgttttgtagatgaatattgtttttcttcttaaatattgttttttaaagcatgtgccttttcaatgggaaggaagtgctgatatttatcaaccatgagcataaatcctccatgaatagtaactattatgcatatcgcataaatttaagttattccttggtatgcacagggaattggttttaggaccctgcagatatcaaaatgtgtgagttctcaagtcccttatataaaatggtatagtatttgcatataagctatgcaaatacctcctatatactttaaataatccctgtattacttataatacctaatactatatcaatgttatataaatttttgttgtactgtattatttttctatttgctttatttttaatgttatttttattttttgaaaaaatacttttgatctgcagtttgttgaattctcaaacacggaagctgtggatatgaagggccaactgcatttttattataaaataaacgcacagcaaaggttattttatccccattttatagatgaaagaatcacggctcagattaagtaactttattagcatcaattcagctaataaatgctgaaggcaggatttcaacctgtatctactatattccaaggattttttctccaaatttttaactgttgtaaatacatataacatacaatttaccatcttaaccatttttaagtgttcacttcagtgatattaagtacactcataatgttatgccaccattaccaatatccatatccagaactctcttcatcttgtaaaactgaaacgctatgctattaaacaaaaacttccctttcccctgtcttccataccatcaatccctattctactttctgtttctatggtattaactaatctaaggacctaatataggtggaatcacagtatttgcctttttgttactggattagctcagttagaaaaatatcttcaagaatcatccatattgtagtgcatgtcagaatttcatttcttttttaggctgactgataacctattgtatctatataccacattttgcttacctattcattcactggatgaataggtggacatttgggttgtactatagtttgggtgtttgtcgtcccaaacctcaggttgaaatctgatcccctgtgttggagatggggcccactgggacgtgttctgttcattggtgcagatcccctaaaaatagattaatgctctccactgtaagcaggtgagtgagttctctgttggctcctgggataactggttgttgaaaagagcctggcacctccttcatctccctcttgcttcctctcttgccatggcatctctgcacttactggctacccttcaccttctgccatgagtagaagcaacctgaggcctttaccagacacagatgctggcaccatgctttttgtacagccagctaaatcgtgagccaaataaacctattttctttgtaaattacttagcctcaggtattcctttattacaccacaaaacagactaagacaggttgcttctacacttcagctgttgtgagtaatgcttgtatgaaattgggtatacatatgcttttcaaggtcctgcttttagttcttctgggtatatacccagaagtgaaactgctagattgtatagtaattctattttttaattttttgaggaacttttatcctcttttccaaagcaggagtaccactttattttcccactaatagtgcaaaagtttttaatttatctgcatccttgctaacacttcttattttctgttattttgatagttgtcatcttaatgggtgtgagatggtatcttgttgtagttttgactttcaccctaataattattaatgttgatcatcttttcaagggcttattggccatttttatacatgttatttggagaaatgtttaagtcctttgtacctttttgaatcagtttttttggtagttaagttttaaaaattctttatatattctagatattaattacttatcagtatataatttgtaaatttgttcttctactccatgggttgcctttttaactatgttgatattgtcctttgatggacactttttttattttaatgaagtccaaattgtccatctttgttgtttttgccaatgcgtttactgtcatatccaataaattattgccaaatctgttgtagacattttgccttgtttttctaagagttttataattttaggtcttatgtttaggtcttcaattaattttgagttaatttttgttcattgtgttacatcagagtccaatttttttcttttgtatgtagatatccagttttcccagcaccatttgttgaagactattctttccccactgaatggtcttggcacctttgtaaaaaatcattagaccatatatgtgagggtttatttctgggctctttgttctgttctattgtcatatatgttttttatgccagtactatattgttttgatgattgtagctttgtagtatattttcaaatgaggaaggatgagttctctagctatgctctttttctcttttgtcttcaagtttgctattttttccaagattgtttttgtcgttctgagtcccttgagattccatataaatgttaagatgagtttttctagttctgcaaaaacattattggaaatttaataaagattggattaaatctatagactgctttgagtagttttgatatcttaacaatacagccttccagtctgtaaacatggaatgtatttatttcttgaatttctttcagtaatgttttcttttggttttttgtttgtttgtttgtttgttttgagatggagtctcactgtggcaccaggctggagtgcagtggtgcaatctcagctcactgcaatcttcacgccctgggttcaagtgattctcctgcctcagcctcccgagaagctgggattacaggcatgtgccaccacacccagctaatttttgtatttttagtagagatgggatttcaccatgttggccaggaagatctcaatctcttgaccttgtgatccacctgcctcagcctcccaaagtgccaagattacaggcatgagccaccatgcccggcctcagcaatgttttatagttttcattgtaccagtctttcacaaccttagttaattcctaaatattttatccttttcgatgctattgtaaatggctttatttctataatttccttttcacgttctttattattagcatataggaatgcaactgatttttttgtgttcgttttgtatcctgctattttgctgatttcatttcttagttcaaatattttgtgtttgtgtggaatcttcagggtttttctgcatataagagcatatcatctgcaaataaagataatattagtttttccttttgaagttggatgccttttatttatttttcttacctgtttgctctggctagaatttccaatgctttgccaaacagaagtaccaagaacaggcattctttcttaagctttaggtctttcaccattgaaaattatgttaattatggggttttcatatatggcttttattatgttgaagtggtttcttctattcctagtttgttgagtattttttatttgaaagaatgtcgaattttgttaaaagctgtttctgcatcaattgaacagatcatgtggctttttcctttcattttgttaatgtgaggtattacattcataaactttcatatgtcgaagtattcttgcattcaaagaatgaatgccactttgtcatggtatataatttttttaatacacttctgaattcagtttgctagcatttggttgagaatttttggattaatattgatagggaatattggtctgtagttttcttgtagtgtctttgtctgggtttggtatcagggtaatgttaatgtcatagaatcagaaagtgtcccctcatcaatttttttgaaaatatttgagaaggattaatgttcttcattcactcatgaagacaataggtctagggattttctttgttgggattttttttttcctactgattcaatctgcttacaagttacataggtctacaatgtagtctggttaggttttgtgtttccagaaatttgttcatttcatcccgggttattccatttattggcataaaattgttaatagttccagcagcgtgatctcagctcactgcaacctccgtctcccaggttcaagagattctcatgcctcagctgcctgggtcactgggattacaggcatgcaccaccatgcctggctaaatttttgtatttttagtagagatgggttttcaccatgttggccaggccagtctcaaactcctgacctcaagtgatccacctaccttggcctcccaaagtgctaggattacagacatgagccacatctcccagcctattttcctattttttatttcatttatctctgctctttattgtttctttccttctagcctttggttcagtttgctcttgttctagttcattttttaatgtgtttatagtcataaatttctcccttagcgctgctttccctgtgtcctataagttctagtatgttgtattttggttttcatgtatccctaagtattttctagtgtttttttcttgtgatttcttctcttatatattggtagcttaagagagtgttatttaattttcacaattttgtaaattttttcagttttatttcttttacttctgctgatttctaactttatcctattgtagttagagaaggtatcttgtacaatttatgtcatttaaaatttactgagacttaatttatggcctaacatatcatctatcctggaaaatagctaatgtatacttttgataaatgtgcgtgtggtatgtttggatagtgttatgtatatgtttgttagatctagttgatttactgtgtcaagtcttctattttcttaattatcctctctctggttgttctattcattattggattactgacatctccaactattaatgtagaattatctacttctctcttcaatttttttgttttactttatatattttgattgtctgttattaggtgcatatttataattgttatttgttgtatcttcttgctgtattgaaccatttattaatatgtgtttttgtttctcataccttttttgatttgaagtaattttgcgagaagttagcattgcctattctgctgtcttttggttaatatttatgtgaaatatcattttctgtccttttacttttaatccttttggctccttaaatctcaagtgagtcttacagacaacacataattggattatgttttttaagtccagtctgcaaatgtctgtcttttgattggagaatttagttcatttacattttaaataattactaataaatacttccttctgtcattttgttatttgttttctatatgtcttgcagcttttttgtccctcgttttctgcattactgtcttttgtgtttagttgattattttgtactgaaaggtttaaattcctttctcatttcattttgttaatattctatagctattttcttttacttaccatgaagattacatttaatatcctaaaattatagactctaatttaaacttatgacgtcttaacttgaataacatgtaaaaactttactcccttaagagctccatcctcactgctttcagttgttcgtgtcacaaaattgtatctttatacattgtgtgctccaaaacacaaactaataattattctaaatgcattagtctcttaaattatgtatgaaatattgttttacaaactaaagttacaataatgctagcttgcagagtaataattgtttttaaaatgtattagtctcttaaattatgcagaaaccaaaaagtggagttacaaactatttttgcaaataatacaagattttataattgcccatgtatctaactttaatgagatctttctacagcttcaagttacttttttagtgccctttcatttcacccttcatgacctctttggtatttcttgcaaggcaaatctaatggtaacaaactcctttagcttttttttacctgcgaatatcttaatttcttcctcacctttgaaggacagttttttccttggattttttgatttttgttttgttttgtttttcttttggcactttgaatatattggcccattgccttcagggcttcgcttcttttgagaaatctggataatcttattgagaaatctggatccttgtacgagacaagttgcttccctcttgttgttttcaggtttctttttttgtcttttgaaagcttgattataatgtgtcttgatgtggttctcttttttgtcttacttggaatttatttgatgtctatatttatgtatgttatgcaaattggtcacaaccatcctggacaacaacccaaaaccctgtccctaacaaaaacattaaaaaaatattagccaggtgtggtggtacatccttgtagtcccagcactttgggaggctgaggtgggaagatcacttgagtttgaggttacagtgaaatatgattgcacactgcactctagcatgggtgacagagcaagaccctacccctaaaataaataaagacataatttaaaataccaatgttgggaagttttcaaccattattttctcaagtacattctgtaccccaaatattccatctctctcttctctttctgaggcttccataatgttaatgtttctctgcttgatggagtaacataggtcccttagactctgttcactttttttcttttaattcctatactcaataatttccattgttctatcttcaattttgctgatttttttcttccacttgctcacatcatcctttgaactcctctagtgaatctttcatttcaattattgtacttcttagctccagaatttctttttttaggttgtcagtctctttattagtatttccattttgttcatacattgttttgttctgttttaccttctccacatcttctttagttatttgactatctttaagaaaattattttaaatattttgtctagtagatgcttgtatgccttgtacttttctttaactctggaaatcagattctccctcttctccagggcttgctgctttttgttattactttttatggtttttgtttcgattgtcgtatgttctcggtgccagtcatcagagtgaggtataaacttaaggtctttttggatattttctgatcctgtgctttttcctgggtatgtatggtcactttctaatttttcctgtatgtacagttgttttttaatgttttttaatatctgactcacaaaagggaaaaataagagtaaaaagagcactggccctctacatgtctttgagttcacttcagctggagagagagaggctcacaaacataggacaaacaacaacagccgctggcctgtttttctacacctctctaactaaatgcagcaattggtggtcagaacacagatgcctgctatttggagaatagggtattttttttgctcatcctgactcctacaagctgtgtgcaggttgctccaggaacacatgcacagctgccatggggctgagggtgggggataggtggctgctactgtgcaaagagctgaaatgggctaaaactaattacagtttactatccaagccttctctttgaagttgcaagccttcgatagactccagaatttcaaaatagttacatcatattctgtcagtgcaatttttttctagatagggaaattactagggcttcctattccaccaccttcccagaaccccttttaggatttttgttttttttccttctacatgatattttcatagtcaatagactttgtacttttagttaattttctctcaaatgatataaatctagcatttatccagccatactctcatgcttgtctgttagccaatagttcacagttttgaacttgctggataggttaggacaatctagaatcatgacacacacattttgtttgtttttttatgcagttcaaacccaatactttaactttcatgatctaacccagagtgaaaaagtccctatgtctcatctatctcctttatttccaattatcagtagaaagacaatgtttataataaataaattgagagacaaaaattattttggttgccccaaaatttaacaagaaaaatttatttaacaaatggtagcatcatttaatagctcacccagctatgattgagtagtcactaccacataaacattatatgtaattgcatgtcattcccaagatcctctgaggtctgacagtgagctggatcctgtatattgacaaacacagctgaatgcttgcttttttttttttttttttttttacattttcatcaataattttcagtctaaccctatgattacatgcttgccacctgccccccaaaataagtggtctatagccttgttagcaattcttcacaatgatacttatcatcaactggacatacttctacatttcaatttcaagatctataagtggaattttaaacatagttttttttttttcattttcagtaatgatacagaacagatgttcaccatccaaagtatggcaggctttcatatttttaatactaacttattttagccatgtgtatatatatgcataggtaagagtcattaattaaactttattgacatataaaaataggaaaaatgcacaaaagtaaaggtacagctcctttacttttttttactgaaaagtagttttactactaaaaagcaaacacttttgaaatgaaatctaattaaaaaaaaaattactagcacaacggaaatgtgctttttgttctcctaatcagtacctacctttctgctccccaaaactaccaggtatacagtatacattttttgtgtatggcattttttgctcaatgttgtgtttgccaaactcattcactgctgtatagtgtttcattgtgtcattataccaccatgtatttatccatttcattgttgacagaaacttatgttagagttcttggctctatgagtaatgttgaaatggacaaactattatttatgtctctcattcacacgtgcatgcatttctacttgttacatagctacaattggtatagctactgaataaaatgtgcttatatcctactttaatatgtaatactcaataatatttcagagtgcttgtaaaattgcactctagcaagcattgtgtgacagatgtattactccacattctcaccaacacttggtattgctagtctttttaatattagctgttcttgtgagcatgtagctgtgccacattgtagctttaatttgcatttccttgattacttgtaaaactgagtacttcttcacatatttttgagcaatttagctatcctttttctgtgaagtatctttttaggcctaatgcctaattacattggatattctggttttttttaattgatttatgtgacatggaacctttgttataatggttaatattggtaagagctgaagcactatactcctttcaagtttctgatgtgaatgatttgtccattgcttttgtttaaatcattttgctagggtttatcaatttcattgcctttcaaataatcaacttttaactttaatctttgttgctatcctctattgaataattgtttgcaattaatttttttctcttgtcttttttatttccttctttcttgaggggcaattagctgttgtttttttaatttgtaaaaaataagatcattagcttttagcctttctcattttctaacatatgcattgaaagctataaatttcactgtaaaacccataaattttgatataatttcataattttatcataatttattatttccattgggattttttttctgtgagctattggcttttaaaagttatttcttaattactacatagagggcttttctaactatctttgttattgatgtctagtttaactattactgtggccaaagaacatatttcacattattacaactcttcaaatatgttgagacttgctttatggtccaatttctagttaatttaggtaaatgttttaaatgcttttataaataatgtatatttttaagttattgaatttagtcgtctacatagctcacttaggtaaattttgttaatcagcttgttcatatcttttatacccttactgaagttttatttggtttgttcattttatacgttaataagagaagcgtttaaaatctcccatgatagctgtagatatgtatgtaactcctttaagttctatttttgttgtctacattttgaggccatgttatgaggttcatacacacatataattgtcacatcttcctggtgcattgaagtttttcatcggaaactgacccttttattatttggtaatggtatggctgatattaatataactcagtatagctttcttttggctatgtttccatggtatatcttttgcatccttttactttgagtagcctcatgttcttacaagcattatatagctaggctaaaaatctgcatctttaagttgaatatactttatttacatttgaagtaattactgttttaaattttaaatctcccatattactttctatttgccccctcctgtcctagattctcttttctcttcattcttgccttgtaaattgattttttaaaaattattctatcttctcacatatttcaaagcacccacaatttgctattttgaaatacttattgtaaaaattttagaaaatgtacgaagtgcagcaacaaaattttatcacacagtatcatttaataattatatttctttccagtcacttctttgctttaagatgtgtacataattttatatcccttcttgaaaagtatattataataatttttaatgtagctatcttttttccaaaacactatttaatagtgaaatgctaatgcattataaatggcattatggtgtgtatgtaaaataatatatgtaaaattacatgtaatatatacattacatatatgtattgtatatataactgtaaaacatttttacacatacacaattttacatattttaagtctttttgtattattaaacacaagatttcacaggtctttgcctatttcctcagaatttgcagaaattattttaaacattataaagttaaatatttctcagattcataattttaccaattattgtaattaaaattctcataaagtttaattatggatacaattaagtgaaagtcccaagcttatagttattattaactattaattctgtgtgtgtgtgtacatgtatacaatcagatcatatttgttattcttggtattctatcagatatctgtttaaagttatgaatcacaaggaacaaaatatcaaatctgatacacttcgaagtctctgtcctgtttttacacaatcaatcaatagggtggtcatatctgcaaaagtaaaagccaattaggtgaagtggaaaaagaggagtctggttgttcattcaataacaggatttccaaaataatgtttggataatggaattgttttattctgtcatcatttctaacaagtagttttaacattaccaagcatacctgtgctttgccttatgttaacaaattaggctgatcagcagccagttgttggtcccacaatattcactggggtttggcaaagggacagccaccttaaacccttctggatttgataactcaatgcacacattctcgccttctgtccatacttgtgttcctgagatcatcgcttaccccaagacaggttcaattaggatcaagaagaattcactccattctaggacttttggttgtgttgttgggggaagtaaactcttccacttgtctgctctgtggtgttatgatcccaaagcttccagggactacaaaaagggagtttaaaattgaaactgtgaaagtagaatcaggctggatgatgggaagagacatcacgtcctgaaggcatcactgagccctgaatcaagttatgcctgaagatgatgtattcctactcttctagtaaatgagtccattcctaatcttttagtacatgagtcagtaaacgcctttcttttcctgtagaccaatttgagtcagactttctgtcactcacaattgaaagtcctaacttcaaggatcctacactttccttcatagcactggtcccatgtgatgttactattacttcagtgccaacctctctcagtagactgtagtctgtatgcaaacagcagcagtatctcatttgttcagagctgcatttccaatacctagaacaattctgacccattattggtacttgatcatattgaattactgaataaataacgcaaaccaagtattttcttagccatgttcccaaaggtatgaataaattaacactatggagctatttttatgtgcatgaaagttgtttcgagatgaaaatacatacatacatatagatgtatatatacagttgtgcacttaaatttctatatagtaatcttccacagaatcaaagattgcctgtgatctctgatatgaatgaaagcaatgcctctttgttctgtgaacttggaaaaactatttctctgagtctctgtttgcttaccagtgaaaagtgcttacctcaaggtagatatttgtaaacagtagtctctcggtaaacagaattcttactagtacaaggaactaactagataaccagaagagaagagagaacaaatagtcagttcaaaaccaaagtgtttgcatggacaaaagcaaaggccagggctgcataacactgacatttttattagaattcatttgtaacaaatggaacttgtgtcagcaaagaactgattttcatacagacttctttcgccaccaatgtaacgaagtaagaaaataaaaagcacgcctttcattctgtaaaacatttacgcgtactactaattagaggtaattgtattttttaacaagccattttacaagttatttgttttaatttttcagtctatgcatccaaaacgagagcaaagaacacaactgttattatctttgtaaagacactccaagctgggatggcaaagccacataacggatggatagaatggatctgtagccttctgatctctgctggagtatcagggcacccataaacccaaaaggaaccaaaacccaaaaagaaaaacaaaaagggaattaaaaataaaaggacttaaagcaaaaccgaaaataaacaggaaagaaaaaaaatacgtgcattactgcagacttttttcccttcctgtttctatgttgtgttatttacatacacacaaatgaatttccgaagcagtttcttacagatgggttcaagtaatatcattattgggtgtagaatcaatagggcagtgcatagtacaaaggtatagaaagtgcaaagttccctagaggcccttccctcccctggctgtcctcgccgttttctaaccatgcaaatcatttttaaaaaagagctaaaataaagttctgtacaaatcactttttatatattttgattttttttaccattgtaactaattacaaaattatacataactacacgtacataggtaaataatagcaccgtactggttatgatgatgaaaataactggaaacttgaaagcttgtggtaatggcagataaagatggttcacctgggaaattaaaacttgaatggttgtacagaaaagcacagagtggaatgcacatcaatgacagtaagggagttagttctaggaacagctcctgaacagtaagattcccgcaatagtctccgcctcgttcgtctatggtatgcatcccattcattttcttcttctgattattgtcatctttccctttgccaaatgggcagttattgtttcagggagagaagctgctcattggccaatcattctggtgtgcagtgctccatcggattctacatgtccaacaaggcatgtctggatgatgcaatgtctgtctgaccccctttgtttaactaaaagaaaattatagcactgagtaatctggcacttggataaatctccaaaaagatacaaactaaaagaaaataatgataacagacccacatagtgcacattcttctctggttctgatgtaggttagagagtctcattctgaggtagccttctagatacttttttttagtattatatatattttcttttttttctttttctttgttttttacaaaagtgctcaaatacaatgcttgcaaatgtttggtctcttggatttcactctgctagcaatgggaaaatgtggaaaacaaaaatccttccatgcagaacatccatgaagctaaaattaaaccaaagtagtatactcataccaaaactctttaagagttccttgggtattttgaggattatttaaaatcatgtaatatgtggcaaacttatgccatcatccatggcttcctatagaaattctgttggaagaattgggggtaagatacatatatatatatagtttatttccccttttagaaaaatcctaatggaatatcaaatatattccaaagttgccaatgatatttgttactaaaataagtttggtgcagttactgcatgttccagagcggatttggaagggaatataaataaaacaagtagctttttctgatgttgatgattgattataaaaggaagaagggccctgattatccaagtgctttgggctggtacaatcactaacatccccgacttggctgaaaactaggaatgcatattattcaaagagtttttgtacatgtggtaaacagataatgctttaatagaaagtaacagatacgaacagtgaatggaaatacgaaccaaaagctaaaaagaaatgctattaaaataggcatcaattataaggcactctaaatgcaaaactaaaaccaaaacgaaacaaagtacagcacttcccaggaatgctgtatgccacaaaatgtttctgactgaacagagtaacatgaatttggctttgcccctgttacatatcataaatgcaaatttcatagcacatactatagacaatatacgattgaatacactttttttaaacaactcgatagctgatatattacaacattctcccctcctaaagggatatgcactgacctttcccacatgcacacctcttagctatttaataataatttttattgcactagagtgttagaaatattgaactttgttggaagcctgactaacaaacaaacaaaacaatttgtggatgtgattgattggttaggtgggggtagattaggtaggaaatcagggggtgaggtttgacaatcaatcactgatgtgcattcctcatttccctttaaagaaataccaatatgtcaaaaaattaagaataaatggaaagagatgtttacaatagcttttctacgtttaaaaaaactaaatcatggaagaactgactgactgataactgtatctattttttgtgtggacacactgtctatatatacatagacacccttataaaatatggatatatatgtatatatgttagcagcaactttatactttgcgcctccctgttgattccaaaaacaaaacaaaataataattatctttgattatttgaagagaatgggtactttctcaccaatcaaaactgaagtgtaaaattaatatatctgacgagactgatactgtagattgagttttgcacaaaaatgtgcaaattttcaaatgatttgatatttctacagcaagatattacagataacagttctacagcttaaaaaaacctacgatttggaaataaaaaaatgaagagttatgtaacttttttaaaattcactttatcgaatgatacattttgttaaaaaaaagtttacacagttagaaatgaagcacaggtcagcagtatctttacaatactaaaaaactaaatcaaggactttctttttaaacattccctcccctttccccctaaaatgttattatgagcagtatggtgggaaggggcgatgtcaaagcagagtccgtttcattgtgagaagccacaccagcacatatcttgtgctgaactgcagcattctggcaatttctccttgcacctttcaagcaatcctgaataagatggtggttctttgctgtgatttcttcttcccttgattttgaatccttgaggtatctgtaaataaaatccttcagatgcctcatcagtcaggattctcttcattatttttcaggttagattattaaactgtgaattcttggtccacctggaataatttgtttttaatttgttttgtgtgtaatagtcccactaagtagttgttagctagaagttaagaaggacttctcaagtgccctgtatggctcagaagagactccatggatattgaagggcctgtagtaaaaatccagaatgggtcaggggtttctacgttgcatagtggtcaaagctgcccaggtactctagtgcggcacgataggaaaactgatattgatcctgcaggagacaatgaatggggagaagcaaaagaagggaccatgagcatattttaatagaaaaataaaaatcaatattgcataacaaaataacatctatataggggcaaaatcactactttcgtcaactggtctaatccaatgaccaattgtttatagtgaacaaagaaaaagccacatggggtgttgattaactttgccaatcaatttgactaaaacgatctcccaattccaagcagtggcaggtcgagtgaacattaccttcccagacaagtgttttccaagtagtatcaaaccattaccaccaattgaacacataaacttcttacatgccttataagcagataatgatgaaaatcatcctttacaattatctgcttattcaagataactaattctcagtttaaatatttaagagaggctgatacagacacaaactgtcctgagaaaaatctgaatttacttatcttctgaactactgccaacagaatttgaatttttaaaaaattatgtttggacagtagagcttgcagtgagaatcactcacagtcatttcagctaccctttggctgtctctctcacttacatatgatgttcatatacagccagaaggtagctggtgcggcacaccaggcacacaaatccatttacacagggcactggacttccaagctttccatccctgaaaatggcttcacaggactggctgcccacatcaaaaaatacctgtaaattcagcccaattctgtgtgattgctagttgtctgttttagagaggcacacactaaaaaaaagcagtatgaagcatggcctttttcagacaacgaagaacactatcatattggaataaattgaagcattgttggagagatggaaaaatcacaatttacagctctctatagggatgaggaaaaggattttccccataaaagaaacctattttcagtggccaatcgggctgaaagtagacagatagtttctattttgcttaaatgtgcatttttctgtaataaaaatggttggtaatgcaaaataaatggtgtttactttcctatcttgtcacagtaagttgcttggctgagtgttaaggctttttaaatgtccaatttccctctgtaacccctaagacccattaagtttgtcaagctggcataatgttttgactattgcaagccaaacacttgcactactttgaaatccgtctgaaagatactgtggatgatgaattgaggaacacatataagttgtataatttggtggccttttgcagaacataaactctatcagtaatattatctttagaaatgaatgctcaatagaccagactggctatatcataaactcttattattacgagaaatatccaaatttccatattaattattggaataggaaatgaggggctaatattaatatctctaggcttatccagaatcaaaatgttttgaatggccattgttaagacatgaaatatagaagagctgatacctctgtaggcatacagagggagaatggagaagttaaatgggctgagattatattatgtactaaatattatgctttctatatatttatatatttatattataggactatgaatataacgaattttatgaaattgccattttattggtcaaaaatggtccagtagtaaaatttaacatagctcaatctaacatataatctcacataatttctatagcaacactaagacactaataatctcatcccatttaaaaagggggaaaatgaggttcaaaattattaaacagtttgatgctttccccacagtattttgtgtctggtgttgagagagtatggagtccgggaggtccaggctagcaaaacgtaggctcttgagatgcgaaaaatgcaatggattttctcacctctgtctgtaccatagctggtcgttgtgttcttaacattttgacagtctggaagatatctacaactccttcatatctcattctttccaaaacaatgcttagcgttatgaagactccagttcttccaacgcccgcgctgccacaataacaaaggcgatgttactgggtgagatgttcacagtcttggccacatttgcttgggtgtggacatacttctaccagcttccacactccgtatctctttatagccatattcaggaaaacatggtatcacattcatcaaatgattactcttgggatactgagttgtaacagcatgtgataatgaggatgaagtaattaggagtaagtctaataaaaggtcttttcaatggggatttataccattttagaaagaccaaggaaacataacaaatgaaaagaaagggtaaataacatataggtttataatattcatggagattctgaaatttacaacctgcctacttaatatttttaaagtatgaaataattcagaataaggtgaagtgaatttggcatcttcaacttttctatcacactgttcacattttgcagttacttaaaatacatatgcgatgcccataacctaaatgtatttgcctataactagtcaaatgtttacactggttttattatgagaaaagagatggtataacagggtatatacgtgattttcacttagtcttcaggagggtttatgactatcctgtaagtgtacgtacacatgaagtaaatactatgttgttttcttatttcttgagacttagaactttcaacagattctcacaggggtctctaatcttaaaaaaaaatggttaagagccattgatctctgaacttagctaccatttttacatgatcagcaactaaaaccacattagaaaggttttgagtttctctctgttgtcttcattgttttaagataactccagaatcttcacggtagcaagaaagaaaattaattcatagctcttgtgcacttaaggaggaaagcaatgggaagttcagataatgagggaaacagtgaataatctgaaaaatccctgcatttttggatcctaattaaacagcatgtgtaacacttgggcacgggctgtagaaaatagatggattcatttactggagggtgtagctgacaggcatatataaatagtgtgtccctttataaatggggtttctacagtctaaacagaaatgttaagtgaggtttgaaaatccaagcggagtcagtctttaagaagtgattgaagatgtctagcggcagtgaaaccttctgttaagatgaagcagatgaccttgaaggtcccttttaaccttgaaagtctctcttagttgtgagaaactgagatttattatctttttgttgaatgatctaggtactccagagtctatcttaccttgccagagtctatcttaccttgatttgatagctcgaatgcaacaaaaacattgggttactttctactaagtattttcaaaaaaagaacagacattggactcacaacttttcaatttactggttttatcatcttactttaataagttataaataagaaaagtggtattttcagaacattcctaaataagaggaaatatatagaagtcttctttgtgtgtgtgtgtgtgtgtgtgtgtgtatatatatatatatatatatatatatatatatatatataaaaggtatatgcatcgcaattcctttagcattatactaaaggaatattaaaattattttatgacaaaaacaatgagaacaggcacacataacacatttatgtacctatacatataaggatgcctaaagttaagaagatgtattaaattaaagatactcttttccttagagattattttagaaaagtttaaattagcatttgggcaaattatgagtaaagataaaagaaatatccaggtaattcaatcccaatatataccatctactttgtctgaatatgggtatacactgttttattgtgctatactttatggagttttgcagatactgtgtttttcacaaattgaacgtctgtgtcaatcttgcattgaacaagtatattggtgccatttttccaccagcacatacttggtttgtgtctctgtgtagcagtttggtaattcttgtaatatttcaaattttttcatactattacatctgttaaagtgatctgtgatcactgatctttgatgttactactgcaattggtttggggtgccatgaaccatgaccataagacaacaaacacttaattgacaaatgtgtgtgttatgactgcttcaccaaccagcagtttccccatctgtctttttctcctcaggcctccctattccttgagacacaacaatatcgaaattaggccagttaataaccctacaatggcctctaagtgttcaagtgaaagggagagtcgcgtgtatctaactaactttaaatcacaaactagaaataattaagcttaaagcccagatgtgctgaaagctaggcctctcgcaccaaacagcctagttgtgaatgcaaagttcctgaaggaaattaaaagtgctactccagtgaacacatgaatgataaggaagtagaacagctttactgctgatatgaagaaagttttaaaggcctgcatagaagatcaaatcatttacaacattcccttaaatcaaagcctaggccagagcaaggccctaactctcttcaattctatgaaggctgggaggtgaggaggctgcagaagaaaagtttgaagttagcacaggttggcttatgaggtttaaggaaggaagccaaccccataacataaaagtgcaaggtgaagcaataagtgctgttacagaagctgtagcaagttatccagaatatctagctaagatcattgatgaaggtggctacattaaaaaagagatcttcaatgtagacaaacatcattatattggaagaagttgtcatctaagactttgatagctacagaggaggagtcaatgcctgacttcagaacttcaaagaacaggctgactctcttgttaggggctcatgcagctggtgacattaagctgaagccaaagctcatttaccatttgaaaatcctagggctctcaagaattacactaaatatactcaagtgaaaggaagagttatacatctctcattttaagtcaaaagcttgaaaaaattaagttttagtaaggaaggcacgttgaacatcaagacaggctgaaagctcgacctcttgtaccaaatagcccagttctataaatggaacaagaaagaatggatgataagacatccgtttatagcatggttgactgaacattttaaggccactcttgagacctactgcttagaataaaagattcttttcaagataatactgctcattgacaacataccttgttacccaagagctctggtggaatgtacaaggagattaatgttctcatgcctgtgaacacaatattgattctgcagcccaatggatcaaggaggaatttcaactttaaagttttgttatttaagaactacattttataaggctatacattctatagatagatagtgatttctctgataggtctgggcaaagtaaattgaaaatttactggaagtaattcaccattctatatgccattaaaaacatttgtgattcacgggagaagatcaaattatcaacagtaacaggagtttggaagaagttgattccaatcttcatggatgactttgaggggttcaagacttcagtagaggaagaaattgcaaaaatggtggaatagcaagataactagaactagaagtggagccaggagatgggactgaactgctgcaatctcatgataaaacctgaatacatgaggagttgttccttacggatgagcaaagaaagtggcttctcaagatggaatatactcatgaagatgctgtgaacactgtggaaatgacaacaaaggatttagaatagtacataaacaaagttaatagaaaagcagcagggttgcagaggaatgactccaattttgaaagaagttctactgtgagtaaaatgctatcaaacaacattgcatggtgcagagaaggctcttgactttgtcacttagtcacttgatgtggcaaacttcattattattttcttttaagaaattgctacagccacctcacccttcagaaaccaccgcccatcgattagtcagcagccatcaaaatagaggcaagaccctcaaccagcaaaaagattaaaacttaccggaggctcagatgatgattagcatttttttttttttttaaactttaagttctggggtagatgagaaaaaagtgctggtttgttacataggtataaatgcaccagggtggtttactgcacccatcaacccatcatctacattaggtatatctcctgatgctatccctcccccaggcccccaccccctggcaggccctggtgtgtgatgttcgcttccctgcgtccacgtgttctcactattccactcccacttataagtgagaatatgcggcgtttgattttctgttcctgtgttagtttgctgagaatgatggtttccagcttcatccatgtccctgcaaaggacatgaactcatccttttttatggctgcacagtattccatggtgtatatgtgccgcattttctttatccaatctatcattgatggacatttgggttgcttacaagtctttgctattgtgaatagtgccacaataaacatatgtgtgcatgtgtctttgtagtagaatgatttacaatcctttgggtatacactcagtaatgggattgctgggtcaaatggtatttctggttctagatccttgaggaatcaccaaactgtcttccacactggtttaactaatttacacacccaccaacagtgtaaaagcattcctatttctccacatcctccccagcatctgttgtttcctgactttttaatgatcgacattctaattggtgtaagatggtatctcattgtggttttgatttgcatttctctaatgaccagtgatagtgagcattttttcatatgtttgtctgccgcatcagtgtcttcttttgagaagtgtctgttcatatccttcgcccactttttgatgaggttgttgttttcctgtaaatttgtttaagttctttgtagattctggatattagccctttgtcagatggatagatagcaaaaatttcctcccattctgtaggttgcctgttcactctgatggtagttttttatgctgtgcagaagctctttagtttaattagatcccatttgccacttttggctttagttgccattgcttttggtgttttagtcctgaagtctttgtgtatacctatgtcctgaatggtattgcctaggttttcttctaggggttttcatcattttacatcttaggtttaagtctttaatccatcttgagttaatttttgtataaggaagggatccagtctcagttttctgcatatggccagccagttttcccaacaccatttattaaatagaggagcctttccccattcttgttttccctcaggtttgtcaaagataagatgtttgcagatgtgtggtgttacttctgaggcctctgttctgttccattggtctatatctctgttttggtaccagtaccatgctgttttggttactgtagccttgtttgaagtcaggtagcatgatctctcaagccttgttctttttgcttaggattgtcttggctttgtgggctcttttttggttccatgtcaaatttaaagtagttttttcccattctgtgaagaaagtcattggtagcttgatggggatggcattgaatctataaattaccttgggcagtatggccattttcacgatattgattcttcctatccgtgagcatggaatgttcttccatttgtgtcctctcttgtttcattgaacagtggtttgtagttctccttgaagaggtccttcacattccttgttaagttggactcctaggtattttatcttttttgaagcaattgtgaatgggagttcactcgtgatttggctattattggtgtataggaatgcttgtgatttttgcacattgattttgtatcctgagactttcctgaagttgcttatcagcttaaggagattttgggatgagatgatggggttttctaaatatacaatgttgtcatgtgcaaacagagacaatttgacttccactttttctaattgaataacatttatttctttctgttgcctgactgccttggccagaacttccaatactgtgttgaataggagcagtgagagagggcatccctctcttgtgctacttttcaaagggagtgcttccagtttttgcccattctgtaggatagtggctgtgcgtttgtcataaatagctcttcttcttttgagatacgttccatcagtacctagttttttgagagttgttagcataaagggctcatgaattttgccaaaggccttttctgcatctattgagataatcatgtggtttttgtcattggctctgtgtatgtgatggattacgttcattgatttgtgtatgttgaacaagccttgcatcccagggatgaagccgacttgatcgtggtggataagctttttgatgtgctgctggattcggtttgccagtattttattgaggattttggcatcgatgttcatcagggatattggcctggaattttcttttttgttgtgtctctgccaggttttggtatcaggatgatgctggcctcataaaatgagttaggaaggagtccctctttttgtattgtttgcaatagtttcagaaggaatggtaccaattcctctttgtacctctggtagaattcgtctggtcctggactttttttggttgctaggctattaattactgcctcaatttcagaacttgttattggtctatgcagagattcaacttcttcctggtttagtcttgggagggtgtacgtctccaggaatttatccatttcttctagattttctagtttatttgcatagaggtgttgatagtattctctgatggtagtttgtatttgtgtgggatcagtggtgatttcccctttgtccttttttattgtgtctgtttgagtcttctgtcttttctatctattttgttgatcttttccaaaagccagctcctggattcattgattttttgaagggtttttcgtgtctctatctccttcagttctgtagtgttcttagttatttcttgtcttctgttagcttttgaatttgtttgctcttgttactctagttcaattgtgatgttagggtgtcgattttagatctttcctgctttctcttgtgggcatttagtgctataaatttctctctacacactgctttaaatgtgtcccagagattctggtacattgtgtctttgttctcattggcttcaaagaacatctttatttctgccttcattctgttatttacccagtagtcattcaggagcaggttgttcagcttccatgtagttgtgtggttttgagtggtttttttttttaaatcttgagttctaatttgattgcactgtggtctgagagactgtttgttatgatttctgttcttttgcatttgctgaggagtgttttacttccaatatgtggtcaatgttagaataagtgcaatttggtgctgagaagaatgtataattctgttgatttgggtggagagttctgtagatgtgtattattaggtctgcttggtccagagctgtgttcaagtcctgaatgtccttgctaatgttctatctcattgatctgtctaatattgacagtggggtgttaaagtctcccactattattgtgtgggagtctaagtctctttgtaggtctctaagaacttgctttatgaatctgcatgctcctgtagagggttcatatatatttaggatacttagctcttcttattgcattgacctctgtacgtaatgcccttctttgttggtttaaagtccgttttatcagagactaggattgtatcccctgctttgttttgctttccatttgcttggtaaatattcctccatccctttattttgagcctatgtgtgtctttgcatgtgagatgggtctcctgaatacagcacactgatgggtcttcactcctctttatccaattggccagtgtgtgtcttttaattgggggcatttagcctatttacatttaaggttaataaggttatgtgtgaatttgatcctgtcattatgatgtttgctggttatttgactattaattgatgcagtttcttcccagcatcgatggtctttacaatttggtgtgtttttgcagtggctggtaccagttgttcctttccatgtttagtgcttccttcaggagctcttgtaaggcaggcctggtggtgacaaaatctctcagcatttgcttgtctgaaaaggattttatttctccttcacttatgaagcttagtttggctggatatgaaattctgggttgaaaagtcttttctttaggaatgttgaatattggccccactgtcttctggcttgtagggttgctgtcgagagacctgctgttagtctgatgtgcttccctttgtgggcacgccgacatttgtctctggctgcccttaacattttttccttcgtttcaagcttggtgaatctgatgattcattgtgtgtcttggggttgctcttctcgaagaatatcttagtggtgttctcagtatttcctgaatttgaatgttggcctgtcttgctaggttggggaagttcttctggataatatcctgatatcctgaagagttttctccaacttggttccattctccccttcactttcaggtaaaccaatcaaagtaaatttggtgttttcatatagtcccatatttctcggaggctttgttcatttctttttactcttttctctaatcttgtcttcatgctttatttcattgagttgatcttcaatctcggacatccgttcttccacttgattgatttggctattgatacttgcgtatgcttcacgaagatcttgtgctgtgtttttcagctccatcaggtcatttatgtttttctctaaactgcttattctagttagcaattcctctaaccttttttccaggtacttagcttccttgcattaaattagtaacatggtcccttagctcggaggagtttgttattacccacgttctgaagctgacatctgtcaatttatcaaactcattctctgtcctgttttgttcccttgctggcgaggagttgtgatcctttggaggagaagaggcgtgctggtttttggaatgttcagcctttttgtgctggtttctccccatcttcgtggatttatctacctttgacctttgatgatggtgaccttcagatggggtctctgggtggacgtgctattcctttctgtctgtctgtttgttattttccttctaacaaacacccaggcctctctgctgtaggtttgctggaggtctattccagacgctgtttgcctgggtattatcagcagaggcttcagaacagcaaagattgctgcctattccttcctctggaagcttcatcccagaggagcacctgccagatgccagccagtgttctcctgtatgaggtatctgtcagcccctactgtgaggtgtcacccagtcaggatacatgggggtcagggacccacttgaggagagagtctgtcccttatcagagctcgaacactgcactgggagaaatgctgcgctcatcagagctgccaggtggggatgtttacgtctgctgaagctgtgcccacagctgccccttccgccaggtgctttgtcccagtgagatgggggttttatctgtaagtaagtctgtgattggggctgctgtctttctttcagagatgccctgcccagggaggagtaatccagagaagcagttggccttgctgagctgcagtggactcagccctgtttgaacttcctgctggctttgtttacactgtgagggtaaaacaaacagcctactctagcctcagcaatggcagatgcctctcccctcacgaagctcgaatggcccaggtggacctcagacagctgtactcgcagtgagattttcaagccagtggatcgtatcttgctgggctctgtgggagtggatcgtatcttgctgggctctgtgggggtgggacacaccaagccaggcactggagggaatctcctggtttaccagttgtgaagactgcgggagaagtgcagtatctgggccagagtgtactgttcctcgtggtacagtctctcacggcttcccttggctaggaaagggaaatcccctgaccccttgtgcttcctgggtgaggcaacgccacaccctgctttagctcaccctttgtgggctgcacccactgtccaaccagtcccaatgagatgaaatgggaaacgcagaaatcccctgccttctgtgtcaatctcactgggaacagcagaccagagctattcctattcagccatctttccagctcttgtaagtacattgttgtttgtttagacctaatgctattgcacactaaatagactatagtataaagtaaacacaacttttatatgcactgggaaaccaaaaagtatgtgtgactccctttattgtggtaatctggaactaaactcccataacgtctctgaggtatgcctgtatttgattccatgtgtcatttcctacaagctctttggttggtttgcaaaggatgtttaataactcaatagaaagtagaaagcaaatgtacatagataaaggtttgcttcttataacatgcctgagaaacaaaggatgctagaagggactttaaacctcagctaagataactgaagtccagagaaacttcattatcatagagccaaataatagaattgagattagaacacagctatcttagcccaagtctaatatttgtcctattttgagatcctgccttctatgtcgtaaagaactatagttttctttgatgtgctgaagcaaaatatattttttaataaactctctcaagagtttcaccataaaaagattagatgtcaagttgccagaaccctaaaatatattagtttaaataaaattagatgaattgcttttgttagaaggtttttgcatagcaacttccaaaaacactaaatttatggtgaatgtctgaactatttacttgctatttatttctattaacttcaatgacttgagttataaaatgctctagaaactattgaaaataattaacttgaaggtgcttcattttctgatatagcaacaattttcaagcaaattgcattttttaactgaggtaccatactaagcacttattgactggcagaacttaatattgtcattaggatttatttgatagctattcatgaggttttcacaaacagaagaaagacagttatcagtgcattgctatgaaagcaaaagcaaatatgaaatgattaacaacgaattattactaggggaggtaccaacaattcccattaaggtaaaattggtaatttggtttgtctaataggaagcaaattttttgggggataaacatttttttggggctaaacattttcctctgattattttcacttattttcactttatgaaaagaaagagaaatcaatcctgctttaagttttgtaatacattgccaagaataaaatttcaaataagcaaacttactacaaaaagtgtatacagacaatgaagaaacaccaccacttatcactgctttattcacaaatggaaacttacctgcaatggactgaaatgggtccatcttggccaaactgttcttttgttttatggacttggccgatgaagtcaataaatccttctccggactttggcactccttgctctggccagtcagtgaactggaactgccttactgttcgggactggccgtcctttagaaggaaagccacatacccggccgcaaaggaagacgccaggaggattcagcaagcatacggaccacaagaacaatcattttcatttcccgaaaacaaaaagggtagaaaaagttaggaacatgtttaaatagaaacttagttatggtttatctgctataaatattgtccacactcacatacctttaaatcctaaatttatttactcttgaaatcctaaatttatttactcttgcagtgcccagttaaaaacctggttctcgttagtagccatccacatagttcccccattaacaaatgtttctgagacccaaagtgggggttcgtaaccattcatcatgtctgcattccttccaaaatggaacatataaaatggaacatatatattccatttcaaaaatttcagaaactaattactttgtaataaatattgaaacaagcacctaggcatgtcatccagaccagagcttttgcagttgtcgcaataacttcacatctgctgtgcttgcgtatttctaccgttgtcaaatgacaaatggtgaaatttaaagtatctgacacaaacccggtagttgctgttaacctggatgccccccatgtctcagaggaataccatttctagccatggcaggggacatagcatgaaccatatgactgtgctgttaagtgggaagtaaagcatccctcaaggataccaacgactattagcaaacaaatgcccttttctgaaaaagagctctccctggctgaccacaggaattaacagtctgtggagagctttaacatagataaaccaaaaggtagaaaaaaaagccagattgaagagcagtctttcttttttagagtgattaggtaaaactgctctgactcacgaagtatatctgggttgaaaagaagacactaaggcatttctgatcttctgatcccttgtggaaatttaaggtgtttctagaagtacaagaaaagtggaagggagcctctgtttatagaagcagaaataatacattgcccatcaaccttctcccctgactcatcagcagagagaaataatccaagcttagagagaccgatctcatttctcatttgaagaggtcctactcctaaatggtctcttctcattaaagagccttcaacttgttcctccattgtttctgttaacacattatttcctcatcaaactttttttagatacacgtgtgcatgttcccaaggttctgggtaagtgaacagggactcaatcctttatcattcactcatattgagaagagagaggatctcagtgtgagatgagcactcatcacctcgcctggtggttttcacagggacatgccagattcctgactgatgttatttggggatggagataaacaggaagatgacaccaagtgtgtgggaatactgagaaatagagaaaactatttggccccataagtactttatggatggttaccatggaagcatgatttacttccctctgtttctggaaaagatttggaaagcacaggaaggagacccagaagctaggtaatacagatttattctcctctgaatgtcctggggatttcatttctgaccacagttgctttcaatagcaagaagaggtcatgtgtgcaaataccttctatttggaggagagactgcctgacttcatttaaaggttacctgtttaacaatactgtaattttcaacccagaattgcatatccagccaaattaagcttcataagcaaaggagaaataaaatcctttacagaaaagcaaatgctgagagattatgtcaccaccaggcctgccttacaagagctcctgaaggaagcactaaacatggaaaggaacaactggtaccagccactgcaaaaacataccaaattgtaaagaccatcaacgctatgaagaagctgcataattaatgggcaaaataaccagccagcatcataatgacagaatcaaatttgcatataacaatattaaccttaaatgtacatggactaaatgccccaattaaaagacacggactggccaattggataaagagtaaagacccatctcacacgcagagatacacataggctcaacataaagggatggaggaagatctaccaagcaaatggaaggcaaaaaaaaagagcaggggttgcaatcctagtctctgataaaactgatgactttaaaccaacaaagatcaaaagagacaaagaaggccattacataatggcaaagggatcaatgaacgaagaagagttaactatcctaaatatatgtgaccccaatacaggagcacccagattcataaaataaagcaagttcttagatacctacaaagagacttagactcccacacaataataataggagactttaacaccccactgtcaatattagatcaatgacacagaatattagcaaggacattcaggacttgaagtcagctctggactaagcagacctaatagacatctacagaactctccaccccaaatcaagagaatatatattctcaacaccacattgcacttattctaacattgaccacataattggaagtaaaacactcctcagcaaatgcaaaagaaagaatggaaatcataacaaacggtctctcagaccacagtgcaatcaaattagaactcaagattaaaaaaaaaaccactcaaaaccacacaactacatggaagctgaaccacctgctcctgaatgactactgggtaaataacagaatgaaggcagaaataaagatgttctttgaagccaatgagaacaaagacacaatgtaccagaatctctgggacacatttaaagcagtgtgtagagagaaatttatagcactaaatgcccacaagagaaagcaggaaagatctaaaatcgacaccctaacatcacaattgaactagagtaacaagagcaaacaaattcaaaagctaacagaagacaagaaataactaagaacactacagaactgaaggagatagacacacgaaaaacccttcaaaaaatcaatgaatccaggagctggcttttggaaaagatcaacaaaatagatagaaaagacagaagactcaaacagacacaataaaaaaggacaaaggggaaatcaccactgatcccacacaaatacaaactaccatcagagaatactatcaacacctctatgcaaataaactagaaaatctagaagaaatggataaattcctggagacgtacaccctcccaagactaaaccaggaagaagttgaatctctgcatagaccaataacaagttctgaaattgaggcagtaattaatagcctagcaaccaaaaaagtccaggaccagatgaattctaccagaggtacaaagaggagttggtaccattccttctgaaactattccaaacaatacaaaaagagggactccttcctaactcattttatgaggccagcatcatcctgataccaaaacctggcagagacacaacaaaaaagaaaattccaggccaatatccctgatgaacatcgatgccaaaatcctcagtactggcaaaccgaatccagcagcacatcaaaaagcttatccaccacgatcaagtcggcttcatccctgggatgcaaggcttgttcaacatacacaaatcaataaacataatccatcacatacacagaaccaatgacaaaaaccacatgattatctcaatagatgcagaaaaggcctttggcaaaattcaacaccactttgtgctaacaactctcaataaactaggtactgatggaacgtatctcaaaataagaagagctatttatgataaacgcacagccactgtcataacgaatgggcaaaaactggaagcattccctttgaaaactggcacaagacagggatgccctctctcaccactcctattcaacacagtattggaagttctggccagggcaatcaggcaagagaaagaagtaacgggtattcaattaggaaaagaggaagtgaaattgtctctgtttgcagatgacatgattgtatatttagaagaccccattgtctcagccccaaatctcaagctgataagaaacttcagcaaaatctcaggataaagaattaatgtgcaaaagtcacaagcactcctatataccaataacagccaaatcatgagtgaactcccattcacaattgcttcaaagagaataaaatacctaggcatgtgaaggacctcttcaaggagaactgcaaaccactgctcaaggaaataagagaggacacaaatggaagaacattccatgctcacggataggaagaatcaatatcgtgaaaatggccatactgcccaaggtaatttatagattcaatgccatccccatcaagctaccaatgactttcttcacagaatgggaaaaaactactttaaatttgacatggaaccaaaaaagagcccacaaagccaagacaatcctaagcaaaaagaacaaggcttgagagatcatgctacctgacttcaaacaaggctacagtaaccaaaacagcatggtactggtaccaaaacagagatatagaccaatggaacagaacagaggcctcagaagtaacgccacacatctgcaaacatcttatctttgacaaacctgagggaaaacaagaatggggaaaggctcctctatttaataaatggtgttgggaaaactggctggccatatgcagaaaactgagactggatcccttccttatacaaaaattaactcaagatggattaaagacttaaacctaagatgtaaaatgatgaaaacccctagaagaaaacctaggcaataccattcaggacataggtatacacaaagacttcaggactaaaacaccaaaagcaatggcaactaaagccaaaagtgacaaatgggatctaattaaactaaagagcttctgcagagcaaaaaaaaaaaaaaaaaactaccatcagagtgaacaggcaacctacagaatgggaggaaatttttgctatctatccacctgacaaagggctaatatccagaatctacaaagaacttaaacgaatttacaggaaaacaacaacctcatcaaaaagtgggcaaaggatatgaacagacacttctcagaagaagacaccgatgcggcagacaaacatatgaaaaaatgctatcactggtcattagagaaatgcaaatcaaaaccacaatgagataccatcttacaccagttagaatggcgatcattaaaaagtcaggaaacaacagatgctggggaggatgtggagaaataggaatgcttttacactgttggtgggtgtgtaaattagttaaaccactgtggaagacagtttggtgattcctcaaggatctagaaccagaaataccatttgacccagcaatcccattactgagtgtatacccaaaggattataaatcattctactataaagacacatgcacacgtatgtttattgtggcactattcacaatagcaaagacttgtaaccaacccaaatgtccatcaatgatagattggataaagaaaatgtggcacatatacactatggaatattatggtgagtgagtattccataaaaaaggatgagttcatgtcctttgcagggacatggatgaagctggaaaccatcattctcagcaaactaacacaggaacagaaaaccaaacactgcactcaaaagtgggagttgaacaatgagaacacacggacacacggaggggaacatcacacactggggcctgttgcgggtttggagtctaggggaacgatagcattaggagaaatacctaatgtagatgatgggttgatgttgcaccaaaccaccgtggcacatgtataattaaattatgtaacaaacctgcatgttctgcacatgtattcaggacttacactccaggagcacagacaaacagcaaatgtagtagctaagaaaattatacaatcacagggagactttaaaaaaaaaaaggtgagcaacttccggtttcaatcttcttttgtttattgtgatcagatttaagttgtgcatgtgtggaataggaaaggtgtctctgccattggtggggcctggtgccttttctttatcaccaggaatagttggtgagtttactcaaaatgcactttctattttcactcacatacctagcttcaaattctgaaagagcactattttttttttttttaaacggtggggcaggttacactcaagacctagagatttaactgctgccttgaatactgtcaccttcagaatagttaatataactttctgggattaacaggtctgtcacctaggccaaccctcctgctaaccaatttctctttcacttaaggtcaacagccagggccaggctttggggattagcagacaatctccaaacctaagtttggagaaagctgctttccagaaaaaacaatggatcaactaaatagctttaccctggagttttattcaacccacccactgtgacagttccaaacacaaggcaggtctttgaactgacctggtctcccttaagatgtgtttgtaatcatgggttgaaagtggccaaaggcgaagatatcagagtttatgcatagaacatcttacatcagggctgaaccttggactcaacaatccagataagaaatgcaggatgaaaattagccaacaagggtcatgggagcacagctctcatggacagacacattagcacactgaggaataagccatgccaggaatcaaattagaatgtgcaaagcttgtcagatttttctaaagaatgccatttgctctgcggttttaaaatcataccaaattaacctctgggtccatatgacctaaagggctttgcaaaacaacaacatatttagagcctcaagtaatgaagaagtcaaaaaagctccaaagagcatgagctgagaaggtgaatgtaagcacagccaaccaatcagtaaacacttcccagcacgaacactcaccaagtgcatccccaaggttgagctgccagatgttatgtttgaatgaaagccaaactaaggtttgtgagaaagcttgccagacagaggaaaagttactcttacatattaaacataaaaaaaaacgttctccagaatgaatgatttctctttgggacaacagtcaagtggcaagtgcttctcccagagagagagagagagaggtatcttagactacttttcagctaatggttaagagttgaagactgtgccaacttaccctggcatctgtgaccttgaattcccttaggatatactgtggcatgttgtactcagccatgggatctacaacaaagtactggtatcttgcagaccgttctgctggccagtattggtgacatttctcctaaaaggagagaagattaatgttaaactatgcaaagtataaagaacattctgtatattatctatctatctatctaatctatctaatttccttatcccattaataaaatttcaaaattcaaggcaattccaattgcatatgactcatttcctcttagaaaccatgagctcccttcatagggaaaccctttggttcagtatttgcctatggcatccagcacggtctctggcagatagtagctgcttaatatacacgagttgaattgagaattgaatactttcatagggtaagcatcttcatacctacaagttatccaaataattacatcagtccttggacaatgctggccatgacaataacacattgcaccaccacagcatacttgcaccactatggtttggaatgaagagaaccatcagtatggacatagaaagaaacctccgaattgatttgttccaatcttacttgtcaaggaaacgaggggcccagtccattttaatgacttggctaaaccctgcagagtcattggccaaatcagagtaagtcagttactttcctcgtctgatattctttttgttctctccgggggctctacaagttgggctttagctgcacttctatttaatttacacaaagaagacagaaagaaaatatctgaagcaaatacgaaataatgcttacatcaagtcaatctaagaggtatctctaaataatattaggtcatagtggtagagcagtattaatagtagaaaccttaagtatttctaatactattttatgtgtatttcaaaaaaaaacaaaccacttttttcaaaagtggatctgggattaccaggttatatccttagaaaaactatgttgctttccaacactttattcaatgggagtgaaaggtaggcaagtaagaatttgcctcaggaagaaaagaaagtcaagttccttcataagtagaaatgatggcacatcaaactctagcctgtccagaacaaaaggcagtaagaatatgctaaaagaagtccgacataagtcaaacggggacacctgctactcatttgtctccatgcttgtgcttcactggaaacaaatcactagatctttctttaaaacacataaatttaaacacttgatgtggctttacaaatttagaaactaacaaggaatgatggtccggattatgtccagagtgcactgcatttcaaaaaaaatgatctagcacaagagttattgaaacaaagtcttcatttctccacagagtaaatgtcttatgaggagacacacaagggccacacacttactctgcccatttcacgcagcttggtgagcatcacaactatggtggaattgtgttcccagagcatccgccagaagtcttcagtggtctctgccaagggcccctgggtagcgatgtaggctttctgttgtctgaattacagagaatgaaaagaatgtgttaaagtatttagagaacatgcaaaagctcacactggatacataaacatcaacctgctaataaaaaacgaaaacatattattaatgcaattgaggtaaattcctgctaagattaaataatcaaataagagcatttaatacattttggggacttcgcaaactaaattgcttgttaatattatgatgtatgtctttatcattattatttgaattttagcgcaatgctaatagctcaatttcattgtcatacaaattacttaagaaacacttagatgtgcagcttcattttctagaaattattctcacacaatctattaaatttatgaaatatggtacaaaacagattctttattaactacttacatatccaattggcttatgaaagaagagtgcagaaggccagattaaacacttcataactactactcctaactcctatccaaaataacaaaaaaacaaataccaagggactaaatgatgacctatgcagaaagaaaatgtctttgaatggagatgaaatttattctggttattaaactagggcacatgtaaatatcaaggctttggatagtcaggggagcaaaagtagatacctgtatccatcaataaaactggcattgatgtaatcagatccttctactccacggataggctgcaggcatacccttgtggattcatatggcataatattaacaaggcgatttttgaatttattacatggaagattggcactgataaaccttgaggtgtgagcttttgagctggctagacgctgttgaataggaaaaaaaaaaaaggaaaaacccaacaaagatcattttcacctacagtttgaatgcagtgtaccccagatttcccttttagatataaatcttttgtttacttaaagtaaatgactattcaaattgtactgcttttcacatctacctaatcactctctatagcctattggatttctatatattttctgaaagtatagtctctcaagttaggagacataagggctcaagatattgttaggaagcaaagaatagaagaggaaaaggggaggaatacattttataatcatacacctgagggaaaggtcaaatgaatcttgtacttcacaaatttgaaaggttaaagtaaagccacgactcaaagacaaacccagaatgacttgctcctgaataaccacatcacatccaataccataccttaaattcgagctccattcctgtgacattctctcccgtttctatttgtgtcagcttctgaatgtaggcatacaagtttctagctggcacttcggtatttccacaagtcactgcttctaacagtgcatcatggataaagatgtattggtcttctgtttgaaccatatagttcctctgggctctcattaaagttacatggccataaatatctacagttttttcatgctttattctttctaacatggcatctatgacgatgaagcaaccagtccggccaactcccgcactatgaggaaaatagagaagaaaagcccaaataaacctatcagaaaatcaatacataataaaagtatttttattattcttattaactagaccttacatccattacttctactcaaatagctattgggatgactttgtaatactctaaagtcaaaagtattatctaggcaccataatcagaggacagggaacaaaagactgagtaaaattagtttagttttaaaatgtaaaaaatattaaatccataatcactatgttccttgatcatgcaatacaaagtgaacattatttcgaaaacttttgaagtcattatgaaaaaaatacaaacatttagtctgtccatatttagaagatagttttatatattggtccagatctggctaggctatagttcttgcaaactctctcaatctgttttcgtcccatgtacaaaacataaagattgtttttacagtctcaagctaaacctcgcatgcttcctatttatcaaacccttcaggctgaggacatttatgtgtcaagtatggttcaatccaaaatactttctcttcctgatcatgcgggtttatcaggctggtaaacatgtcatcaacaggaataggtatataataggtgtatattaccatcttaggtaacaggcaacagacagcctccttcatttgctacatgctatgtttcctgtcatctgtgtatctatgtgttcatttattgtccatccctcattgatctgtccatttcttcattcaataaacaatgaagtactctgctaagtgaaataggggatacgacataaagatgacttagatgctatctctaaagagctcagagtgtatcgaagggacataatactttatacacagctatttctaaacaagaaagaaaaaggatgtattagttttgtatatgatgtggcatttgaagtaggacttgaaggacaggaaggatgaggaattaaagatgttgtagtatgaacaaaggacggatggctttggtaatcacactgctggctctgggagctacatgtgaaattttcataggtctggcaaggcacctttgcaacgaagataccagaactccaaaacaaatgagttaatgctcaccagggtgcctgtctcaactgaaatggcagtttctgtttggtatcatagtggctgcaaggcagtaagagatcattttttttttaaacaaaataatacctttatttaactgctgaacagtgtatatcaaagctagcttgcatacaggagctctgtggtttacagactgggctaactagctgggaatttgatataaccactactttaaaataggttacttttttatgtcctatgccagagggctcctgaatactgatgccaagaatccaatcccaagtataaacccacaaattgacatgacattgatatatcatgcaaaagccttctgagacagagagtcctacaaatgatagcacataccttagcacagaccaattggcaacctgatgcaaacattaatatagagcaaagtcggcctggtggttccagttccttgagatccatgaagtctcattttatttagttggttctaaagaaacctgttagatggcgagttttccctgacattccccattcctaccctcccaggtggttttaatcatcctctgcctcagatccctggttgccctcaaatacccctttactacaattctaaccaaattatattattaatttagggcagccatccataaacaacagcatacatcttgagagcaggaactgcattaaaaaaaatatttgtgtgccctacacaaagcatgcagtaagtgctcaacagtgtttgtgaaataagtaaacaaattagtgactggcttgagatgcctgcagtaatgagcagcccgtcccggtaaggtaagcctacttaggaagcaggactcttcagaccatgcaaaatcctacatttgacaagggtttggaattatgtaaggagtacccgaggactcctctgcatagtgtttgatcaggaataaagagacaggaaaatcactttaagtagtctctttgctggtctcctgatatgccatcagattgcagttaaaggaacctaagtcagactcaacctggaaaagatttgtctttctgggtttctttcaaactccatgtttggcaggtcctgagactccaagtaacatctttcgttctttctgtgttgtctttctaaattgtcttcattgcagctgtgaatcgtttctcatggacacagttttatgcagttcttcccagtggaaaccacactgtaaaccttagaactgagccctatacatcaagtcaattctagataatggcaggactattttctcaaaatatgcatcagggaccattcaaatgtctggatgatgcatggttctatattctggcagaaagatactacagaatcttgcaaaattggtaggaataactccaactctaaacagtatcaaccttttcataatggtgattttttttttccaaaaaataagggaaaaaaatcaaatacgtgtgagtccaaatcatgaattgtgggatgaaaagaaataacagaggctatgacttgaacaaaacctattttttcccccacaattcaaaatattgttaactgcccaatcctgctattcatatggaagatagggaaggagctgacgtttggaacttaatgtgttaccttcttctaggatgaagaattcttgagggatttaaacattaaataagtgttttcgcttgaagcaagaccttgaggcttaaggtacctcttcagacatcaatggctgtgtgtccttgagaaagacattttaaccccttccttatattcccatatttcttaaatgatagtgacagttaactcttattaacgttaattttctagtgagtctaattatccagtaagtcttaaggctaaattaaaaataccaagtgttttgcaaacataatggaaaaggcagttactttctaggtacaaactccattttaacattcagtctctaaagctgacaatgagaaacaagcaatgtaatgctgggaaaattatgacagaattactttagaaacatttgagatttggcttttaaaatcttgctttcgtctactctctcaagctgctcttcctttcctctgccttctttccaataaatgtgccttatacctgaggagctttctgcgttcacatttatcatcgtggcaaatgagatggcaggcaagggccttcctaccacagtgcttgacacctaagaagcattcagtaaatgttggtttcctttccccttctctgacaacacttgggaactgccctgaagtcctacagtcatgcacgccatacctggatagcagagaagactcaaatgcaggttctgaggtgttaaaatttagcaccctgttcccagcacccccagtgcttcacaatgctttccaccatttaggtcagcagtcattgccaaatatggtgactttcctgtagagcgctcgtctgtgatatttcattggcagcatttgactatccctaatgcaggttcctagaaaagctttctatccttggttttaaggacactagtcaagggagtatgggaaacatcagatactcccttggggttaatggtagcaagggtggagattgtgtcattactccagacacaaaataatccaaaacaggtagtacacgaaatcagcccaaaataattgtatcatgatcctgtatcacggttccattgattctgtaacagggtagaattcctaccacgtttgaaatcgaaatcaaagatgaactctaaatgtcatcttcagaaatctactggcatccgttcagactgtgcctcagtatgtttcgttttgttttttttatttgactccagtgctaattctctacctgcctctctggattcttccatctgtatcaatttcacggattacatatctctgccagtccccaaaatgtagataatgctccaaaagttctgtccttctttctctcagtagtagtctccaaaggattcctaaagtgatgcctttctttttcagcacaagtggagatctatatttcaaactgtcttcaagtttatcaaaaataaagattctaagcttaatcagtatcttctcctttcaaatctgctcctcccactctcaggctctccttgacactcaggtttaaaactgaaaaatcatcttagactctttttgcctcttaccctgcaaaataataaattataaattgttatgtattcaaactccacgattatcttcaactccccatcagtggtgtgctagagctagcaaaagccaatccttacattttcagggattatttgctgaaataaatatattaaaaataaaggtaatatataaaactcattgtttcttaattgtttcaaattattttatgctcttgaggtgaaaacatcatatagagtagtccccttttatctgtggttttgactttctgcaatctcagttatttgcggttaaccacggtctgaaaatattaaatggaaaattccagaaataagttttcaatgacatacttttctgaaaagtgtggtgaaatctcaagccctccctttccatccagcccagggtgtgaatcaatccctttgtccagtgtatccatgctatacaggctgcctgcctgttagtcacttagtagccatctcggttatccgatggactgccctggtattgtagtgtttgtcttcaactaacccttattttacttgatggccccaaagtgcaagagtagtgatctgggcaatttggatatgccaaaaagcagctgcaaagtgcttcctttaagtgaaaaggtgaaagttttcaataaggaaagaaagagaaatcgtatgctgaggttgctaagatctatggtaagaatcaatcctctatatgtacaattgtgaagaaggaaaaagaaattcatgattgttctgctgttgcacctcaaactgcaaaagctacggccacagtatgtgataagcacttagttaagatgaaaaaggcattaaattttgggtgaaatacatgaacagaaacatgccatgactgatggcaagtgagcttggtactctctggggactcaggcatccactggggatgttggatcatatcccctgcggatagagggggactacactaataatgtgctggtgatcgtctctctctagtgacctcatgtttgtagcttgaaatcatccatgggaatatttacaccaaagaaatcaggaaatactactttttttctccccagagagcaggtttttacatatttaccagcacatatgactatgctaaagcatccattcccaccatccagggacaaagaggaagagttcctaactttgttcttccatccatatttgttgtattttcatgactctgtcgcctactattccacaaacatttactgagtgcctaccatgtgctgagacatcgaagaaggaatgagcagaacaaacgtgatctttcctgtcggagcttacagtttagtgggggaatctgacattaaataatcacatgaataaacatctaattacaaatctcaagcggcgctgtgaggcaaatgtgaaggatgctggtagagcacctttgaggaagtgccattgaaactgaaatctgttatgggctgaattgtgtttttcttctcaaaattcatatgttgaaacgctaacccccagtgtgactgtattggacacagggcctttagggaggtaattaaggttacatgaagtcacaaggtgggagctttaatcagataggatggatgtccttgtaagaggaagagacaccagagatctttttctctatgcatacacagaggaaaggccgtgtgacggcacagtgagaaagtagtcatctaaaagccaggaagagaggcctctcctgaaaccaactctgccagcaccttcatcttggacttccagcatcctgaatggtgagaaagtaagtttctgttgtttgagccactcagttcggagtattttgttatggaagccccagcagactaacgcaatacctaaaggtcaagtaactgtttgctaaataaagagggtggaaaagcttttgaaaagatatcctaaaaaaaagtgctagaatagacaacatagcacatttgaataactaacagaaagccatcggctgaaaggcagtgagggaaaaagagggcatgttccacatagttattttccattttagggactggctataacatttttattaaacttataaccacatcagcagcatttatttagaataattctgcctcacatgtttcacagtttatctttctgacatggctcatctattcttgagtttattttgatgcatctattggttggctggaatatgtctttgaataatgctttatataagatatgcatggatgccactttttctgatgccttatatatctgagaaaccctttgtgggtttctttttttctttacatatgaccaacaacttggttttgtgcaggattactgggctccaatattatctcttcaaactctaaatacattgcttcacggtctttgttgtcctttgacaaagtcataggccagtctggtttctggtcttttaatagtaatttttgccccaagtaattgggggttgtttctttaacttggaggttcaaaaatttcatctagatatgctttaggcattgatctcactgttaaaaccgcagggccctcaggtaatattttcattacaagattcttggctgttcctcagcactagttcaaattaaacatgttttatgctttcccacctctgggcgtttgtgacgctggaccttctacctccttctcatctgttgacatgtactttccttcaagattcacctcaactgctgcaccctgaatcaacatttccttttgatttattcctccttggactcttttgacaatttataactattttttcagcaactgccttactttagttttgttttctggttattatccttatgccagttggcgctctcctccagggaaaagacaacagcttcgttgtctctactgtttggcaatttccatgccagggaaattgaaggtgctcaactcgagtgacaaaatttataaaaaaaaaaaatttaaaaaactttaaaaataggaagccctctcccagatcaataacacataggggaacatttccccgaagcccccagcatgggaaaattcctttgatacatgtttacaaagataaagtaatgcttataatttgatgagatgcaaacaacctgtgcttatgcttcactccaattgctgagaaataacaaacctccggcacttatttttccttaagaaattgaatgttgaaaattcagagcttttaaaagtatcccagcctacttttgtttgaatttccaagttcccacagcagcatatatttattttgtttccttctccaatttactctttttttgttcacccatcagtatctgagtgcagtgcacctctcaaaatgaaggattgtacttctaaaagcaaatgcatttttctttgatcctgaaaaactcagctctccattgcagtgataatgacggaaccctatttagtgctgtttgtttttcatcatttcaacagccttcaacttgaaacatgataagaacagcaaaactgataaaccacccttatttttatctgttttctgtcagagtagttgccaagcactgagacagatttttctaaatatctttttaaaaaaggagtgcataaccctgtgcttcaggctgaggccagcacaatttagtacatttattatgttatgttacagaaaattccagcaaaaagagaacggcaagtttaaatggagtctagcattatgttggtctctgttatccctaaagtaaaatcaactttttattttccggtgaggacaactattccactaatgagaatcagaacacaaactctatatttgtttgacttcagcagcaaaccaaattattgctaaactttagtggttttttttttttttttaaatttcagtaagtgatagacgttccagtgtttacaagctgaaagactatgcaatccattaaacaagtatgcctactaggaaattgttattacttcaatattatcattcatccagttacaacatttgttttcaatttctaaaaacatgattgagttagtcccacgagttgaaacgggcttaatgtcccgtgatgtgatacagtagtaatgtgcaaaaagaaaaaattaagaggcatacagggactgttttatgctaaagtcattctggagatgtgtttaaaagttggcttttctgattaatgtggtggagttttaatgctgaccctttcctggtacttcactgatctggcaaagaaagacaatagaattaggatatttcacacatcatttagttgggtgccaagacagtaaaatatggactaaaaaaatcattgtgagcattttgtacatatgtcagcttataatttgattggatatagttcacctatcataatggtatatgaactacaagtatttgacatctatgagaaaagattgagttttacgactcaggtttataagattaattaggtgactcttttaataaaactgtgatgtgactctgatgaggctgccattgtgaaaaccttctttcattctttgataaaaatcaacatttaactttataagcagatactgggcatctctacgatatttggggttcactacaaaaaacagacccacagataggttagtttcttctagcatctcttttacctaggataactagagaaattatattaatttctttgacaaaatattcagctgtctaacttttatatattacaaaattaaaatgaaaaaaaattgaacaaattgtcattgatacgcagtcaaatttgtccatgctattcaacatacactatatccctatactaattaatatatagtagttatagcagttttaaggggtagttttgcaatcttcattaaaatttcaaatgcacatactctttgacccagcacctccaactctagaaatctagcacggaggtctatctacacatatgcacaaagagagtagaaagagattttattgtagcattgttgatgtagcaagttaacttagtaaaacaatcatggctagggaactagttgaataaactatggtatatcaataccatggatgtgatgtagcagttaaaaagaatgaagcgaatccatgtattgaccctctccaaaatagcatctaagacattgtcaagcccacttaaatatattgcagaacaatatatataacataacaccacttacattgttttaaaagtccattcaggattacatatctctatttgtacacatgttaatgcacaaaacatggtctgaaaagatacacaaatcagaatagttctgagaaggatcggtaatggtggcagtacagataaactttcactttagttgaagtatttttttgtagcttttttttttaacaaggataacataataatctaataatggaattaagaagaaatataaagcaatgggtaaaaagttactataataaatatcataattacagttcaataaagagttgaggctccaaagacacagagagaaaagatggaacctaattaactctagctcaggaatactgccttgctcagtgatggactgtcagaagtctgggtgatgttggcagctcctgtgtagcccagacttagtcctgccatctggtgctggcttttaaagagtggatatcagaaagtaaggggatataggagtcattgtagagaggagactgcttggcaaagagtaaaaaaaaaaaaaaaaaaaaaaaaaaaaaatctagagttagggagatgacccagagccatgatcactccagaaaggtaaaatgtagtacacttgagtggtgtcttctgaggataaaggaagttcacatttcatcaacagagaaggggcagaaactaagcacaaagttcccaaactgcctgataaggatccttgtatagaatactgaaagatcagggatgagctaccaggttatatccctttgggtgttttatttttccatgctgggtgaaaaggtaatttcctaaaaaaccaaaactccgtctcgagaaagaaaaaaaaaatccacatgggcctaatctgattttttttttttcaaatatgtagactcaaactaaaatcttccaaagacttctgcatgatcttggctttgtcccaatattatctgctgaacacactccctattattcttaaaatgtgattctcatgataaattagaaggctaatgtgttcgcgtaaagaacacctgaatatgccgcagcaggtctcattttacagatggatagaacaggccattaggcatggatagagcagactcagctggctctgataattggtagttgacttgaatctgaatagaggtcaatcaaatgatgctacggaagtttagagaactatatcattcacacagagattttccttgtaaaccataccagctcactccgtattctaaattctgtttagagtgatacaaaattgcccactttttgaaagaggagacaaccatttaccaggcctgccaagtaaagctgcgtgggttgtatactgctcaacccaaaggaagttacaatcacatggactacgtacaacgtgtgcaacctgctcagtccacacagcaggcttgtcattagaaatataaatgctattactcctgattcaggttaagcaagattcaaagagaggagccactggaaggtacttggagggcatttgaactttagcaactttgattagtttgtaaggcatatcattttcccacacagacaagattttactatgtacacaaatgccaggagttttttggtttttctttttaaaaaatgctattattgcccaggcatggtggctcatgcctgtaatcccagcgctttgggaggctgaggcggacggatcacgaagttaagagattgagaccatcctggccaacatggtgaaaccccgtctctactaaaactacaaaaattagctgggcgtggtggcacatgcctgcagtcccagctactagggaggctgagacaggagaatcgcttgaacccagaaggtggaggctgcagtgagccgagatcacaccactgcactccagcctggcgacagaacaagactccgtctcaaaaaataaataaataaaagaaaaaggctattatcgttatttaaatggtattgtccaatagtttggaaggctctaaatctgtggttccttgtttcattttgtccttttgtttgactcctgcaagcttttataaggcagtgagaatctcactctcaatacaatcagtttatgattgtttgcaacaccctagcaacctccagcaggcctttgtgttggttttgtagaggcctgttatggcttctgatccggcttcttaaactcatgggtttctgaattatgaatcagtatgcctatttatttatttatttatgaatgtatgaatgaatgaatgaatgaatgagatggagtctcactctgctgcccaggaggctggagtgtgctggtgtgatctcggctcatcgtaaactccgtttcctgggttcaagtgattctcctgcctcagcctcctgagtagctgggattactggcacacgccactacacccggctcattttccttatatttagtagagatggggtttcactatgttggccaggctggtctcgaactcctgacttcaggtgatctgcccgcctcagccccccaaagtggtgggattacaggcatgagccactgcacccagccagtactgcccattgcctcttctaacccttttgcctactcacattcgtatacatatacaaatttgagactccttctcaaaaaaaaatatatgtatatatgtatatatgtatatatgtatatatgtgtatatatgtatatatgtatatatgtgtatatatgtatatatgtatatatgtgtatatatgtatatatatgtgtgtgtacatatatatatatatatatatatatatgtttttttttttttgagaaggagtctcactctgttgccaggctggagtgcagtggtgcgatctcagctcactgcaacctccacctcccaggttcaagcaatcatattttttaaatatgtcttttatttattacataataaattgaaatttttaataccttatttatatttatccaaaacttagaagtttaagatcattgctaagtactccttattctttttttcactttttcataacttttctattgtaattataaggtgctagaatccatagttcatcaatgcaaaatgtaaaatgggattcacttccacaaagtcaaacacaagaagtaacagcaaaataaacagaaaaactttatgtaacacattcatccaatgaaataactatctaccatgactggtaatggttgtcctacaagatggacgaaaatttcatgaaataacaccaatacgaaaaatttaaataatagtaatgtttctacttttcaattataaatggctatccacataactgaattttcttctaatctgcttcaagacttaaagaattttctttttctttcctgtactaatcattgaacctcagtttctaataaattttggagcatctgggcctttgaactccttgaataaaggtactgttaaaatactaaggttttcctgtttgttggttggtttgactcaagtagttgcatatatttacaggcttaagaatttgatgaagatcacgtggctgtcactagggagctaagacttgggtccacgtctccccttccaccagactctcacttccaccaatgggagttttactatgaacagatgacagttttccttggagctccccagatggacccaaggtccacgattctatcaatcaatttaggctgtaagaatgttggtccaagagagaaatgctgttcctgtaattgtcttttattcatgaaacattagctctcccactctactgcactactgaaaaataaatgaattaagtggtttttaaagcactgccaaaataggtctttgtgaacctggtgatatagtttggatatgtgtaccctccaaatctcatgttgagatatgatcctcaatggtggaagtggagcctggtgggaagtgtttggagcatgggaggtggatcgttcatgaaggcttggtgccctcacggtggtaatgagggatattgagtttacatgagaactgattgtttaaaatagtgcggcacctctcctgtctctctcttgctcccttttgccatctgatacactggctccccttttgccttccaccaaacttcctggggccctcaacagaagcaaatgccagtatcacgcttgctgtactgcctgccagaacaggttgtaggccaaataaacctcttttcttcagactaacatacctggttatgtatcagctagttacatttatgtcagctctatctcttttagaatattttggtctatggttgaccttttagttcgagtggtatgcatacatactgacgaataaataagagctagtattaagtgtatttagaataacctactggtcatgtttaaggatgacagtagagaggacagggtttgcctctcatgcagaataatactagaagatgggaaacagttaagagactgtgacaccaaagagctgaaggttaatattcaataattcaactcaatggatgcaaaatgggagattcctcttctatgtatcaatcgccatgcagtgtaccccaggcatatatacattatatgttcaagtagtctgaacatgctgctagggactgtgagagcacggagacctgggctctgtcccagaggttcttattcagtaagtctggggtgggaccaaagattgtgcatttccaacaagttctaaagccatgctgatatggctggtcgctgggccacactttgggtaatgaggatacaggcacattgctaacatttttatatgtaaatacagacaaaaaggtgcacagaatacactcataataatgtacatatgtgtgtgtttacatacatacacataaatttaaaaaaatcaaaatctctcattcataaggattttttgtccttagcaatgtaaagttcaatggaaaggagagaccgcaaagggctgctttcaaaaacgcaaagtttgcttttcattttttttaagaccaaatactttactatctccagatacctgaaaatatatggaattatcttgtaataaaactcagatgcccaaagcccaccttttgagttttctttgcaagaaacaaccccaaatgcgagcaaatcagataccatgtaataagacctaaaagtatttttccaaagacagaaagaaaaatatctaagcaatagaacccagattggaaagacaccaaacaaagataacagaactatttttaagcctcattttatgaccaaggggcacagcaaaatagtttgaaatagaaagttttcatgctgattacatgaaatcaaaatacacactgttcaaaggcagccaacattattattttttaaatgcagtctagttcatgcaataagtttcagtgttctttcagtctgggaacatttcaaaatacattgcaggtacagctgggaaaactcagtgatacccctgtccagatctcagctattaggttataaaaatattttcacatttcctgcagatgtctagattcctttctttggtagtaattttaattcagacctcattattgacagctgtttgttctgatagaacttaattgctcttctaccagactcagctgcaggcaggctgatttcctttccttatagagtatattacatataaacacaggcaggaaaaaaataaccaattaactaaatacgtgtgcataaaatgattcattgagagctctgatcaagtaatgtatccaactgcaacataggtcaaaggaaattacagcacttatagtttacagtattaaatataattatatagaaatactcaaaagcactaaaatatatagatgatgagtggcagcatctgaaaatctacttttatcaaagaaatttataaaattactatatttgagtaactggaagggtatttattctgctgacggattaactcatggatatctattttacataagctatacgctacaaagaacctgagatgccttccataactgacaaagtcatgaggaacccagcatgctgtgggatcacactgcaatgccaacaattcttcttcgaagggcagagtttctggggacacaccaactcttttcctcattctccagtcactgctgtggatgagctgcttttcctaactttaccagaaaatgaatacaaattctttgaagttaaagctattccctctgtttgaagacaatgcctcattttagcagctcaccaagagatgcaggaatagcttggcaattttcattctatcaaatgccttggcagcctcactcatggagtctaggcctatttggagaccccaagctgccttccttactggactggaacccctgaagagggataaaccgagggctgaattcatcaaagaacatataagcagcaaatatactgcatttgagacaagcaatagttccttttattggctctgtctgttttggaaatggagagaatgtggtgagcagggaagaacaaactgctccttagtaaggaacccactcaaggaaaatgaagtttttttcttaatactagggacgctatatggtgcatcccttttcggggccaataaatgcttctctttgcagacttaatctacctcatatagggaggaagatattgggaataggatgcttattaccctgataattctcagggatgcagcatacatttccattaatactaggcataatgctaattacaatgcaagccccacactcaacatttacaaaccctgacaaaatgaatgtaagtatcctacagggtttggtatccacaaaatctggtcaatagcctactcccagtccctccctttcccctaagtaacaaaggaaaccaatacttcttggtctttgagagtaattctactaagtcccgtattttttagtctatacatacagatcattatacccttcagattcttgcatggtatgactcctggcatcgttttggattgtgacacttctactctaatgctcactttatttagtgtctgtttcacacatggcatagttctaagggaggatgcaatgtgacctcatagacaccatctccaaccacgtatctctaacggttgaaagttacagcctggggaagaaattcagttttggctcatggaattaaagacttactacactttaaaattccccccatcatttttttttttcttgaaggttcacttcttactggttaaaatagtttaaacataatttaaagtcctgactgagttgatgatactgactattttgttttcaattaagcataacagagcaaatggtctttgatgtgatgtactcattttatgaaagaaccaggctggcaaacaaaaattttatggaatttagagatactaactctggctcttccacctgcagcttgtatcttaaatacatcatttatttattcttccagagcctctgttttctcacctgtaaaatgtaaacctatttcctaagttttctatgatactgtcagcaaaatacattttaaataatagcttcttgatcaatgttaatttcagtactcttttttctatgaattgaggacctagaattgaatattttaattcagttagcctaaccacagagtagatatgcaaccttcctattcttgcatagtttattagacttctactaataaattttatgaaaccaatatttaactttattttctggtttaaatcctctcaggaaaaaaaaatgtaatataaaattgaatcagatttcttgtaatcccagcactttgggaggccgaggcgggcggatcacgaggtcaggagatcgagaccatcctggctaacacggtgaaaccccgtctctactaaaaatacaaaaaaattagccgggcgtggtggcgggcgcctgtagtcccagctactcgggaggctgaggcaggagaatggcgtgaacctgggaggcggagcttgcagtgagccgagattgcaccactgcactcccacctgggccacagagcgagactccgtctcaaaaaaaaaaaaaaacaaaaaaaaaaaaaaacaaaaaaaaattgaatcagattttagattcggcagggatcttagagatctggtggttctcaaagtgcggccccatgaccagcagcatcagcagcatgtaggaaactgttagaaatgcaatttttcaggccccaccccaacctagagaatcagaaactcaaggggtggggtcaagcagtttgaattttattatttcattatttttgagactgagcctcgctctgttgcccaggctggagtgcagtggtacaatctcagctcactgcaacttccacctcccaggttcaagcaattctcttgcttcaggctcccgagtagctggaattacagacatatgccagcaaatttataaaataattataaattttatagttttagtagagacagggtttcactgtattgcccaggctggtctggaattcctggtctcaagtactccacctgcctcagcctcccaaagtgccaggattataggcgtgagccaccccacccggccagctatttgaatttttaaaagcccctaggtgattctggtgcttgctaaagtttctgagccacccatcaagccattctcttgcattttacaggtggagagactcaggaacagagactaaaataaaatctctgtatttcagttgcattgctttgtttgtgtcaaagttctgttttcctccccttatctcaagtaccacttagtgtttgttccatcatttcttcctttccttaggcatatggctatcaatatgcatggtcttatctgacttccatttaaccaatttaactcaagctttccttttcctccaaaaagctcctcccattgcttactgcactaggtcagctcaatgtttgttaggaggctactctccaggttgtctgtggctctagaatgtttgtggtgtcatcatgtttattccaaaaataatcagtcatttcatttaagtaatgtaattcttagataaaatgacgagatatagttacaaaataaatgagttgtttctgtaaaaaccaagttaattactttggaaagatagacgtaaaagtaatttgtgtcccgtcatagccaataaagtaccattgaattaggtaagggtgacacaactgcaggtaaatggaaaaatatttataaacatctagatggattctaaagttgcttaactttagaaacaaactactgtttgctgttgatattaaaaacactaaatctgctaatcattggtcatactcaaataagagttcttagtcccaaattttaaaaactggtgaatctaatatacagttatgcatttgaggttaatgtcaactgtatacatacattttagggttctttgcttcacttgaggttttgtctaaatgatcaagtctaaactgaacatatagatcaaggttccttctgaatggtcttgattgctttagatctcttcatatatgatgattaagctttttgaaggagataccatactctataacccacagttttgcacagtgaagttgtaataaatatttactggttatatttatatatacattttattgaatgttgctaattgattagccaattacacttagtagttcatcatctcgttttattactgtgagccaaattatccaggctatgaaacatttcttttatgatagcacttcctggagtccttagagaaattccaaggggggacaaatagttctataaatttcctcttgaaggctcacaatgcattaggctgagaaaccctgctgtaaagaaaccagttaaacttacttttacccatacttatttgactacagaaattcacccccctgcatcaattaataatccatgattcaatgtgcacatatattgatgaggtatcccaaattttctaagtgattttcattcttatgttcaaacctttttttctgtttctgtagattttctcatacttcttataacccagaataggtgtgaattatgtatgccaattatgaatgcgtcagattaaatggtcaacatacggatttgtaaaacttagattggtaaaactgctatttttttctattttcttctttcttctcaatgaagtagcagaacattttaaatctagctctgctttcacagattaaaagaaaaattttagcaggggaatgtgaaacttagaatgtcaaataacaggcagtggtggaggctttgatgaactgagcctaattaaaagtaaaggtgctgagtgaaaattttaaaagactgcaagccaaatgttgctaaggacaatttggggtacaagctttccaaagagggaggtggttttaatactctgtaatcattttgaaacttcatgctataaaagacttcagatgtagaaaagcagtctaggtatcagattataacagcataggacacctagtctaggagcactcaacctggagtcgagaaagcagtaataaatgccctttacactacctctgtccatggaaattgaatatttacctgagataaggttgcccaggctattaaaatctcagatgttgaatggcagttatgtaatgagtttctttgaaaaacagaaaatgaattgccatttaacaaacactgcctggaatgttgataattgaagctgtgtgatgcgtgcttgggggttcattatacattctctccactttggggtatgtttgaaaatgaccaaactaaaaaaaattctgaaaaaacagcctcctttgttcccgcttaaggtaaagcactttctaagtgtacagaagtcccccacagggcagaaataacaaagaggatcgtgttcagacccactcaccttcttccaatagctaggactggactattggtttcttaagccatagccaaactgtgatatggtgaagctttagcagaaaaccatgtgacttgatgagattgcccatgcagaaatgcaggcaaagaattcagcaagaggtatgtagaccaccttgggaatttgtacctttgtacagtatgcaggccacaaagcttcactctaaaaatgacttacatgtagaattattatctcagattttaaagatgtgtttattcctaagcctttagaaaatataaacacaacaacaaaggcatacatacctatctcttgtaactggactacattcacagagctccttactaaattctggaagaggttttgctaagcttgtagctttactattgtaccctacaaaccaataagtttgagtttaattgaaccaagatagcaaatggatttcagactatagtacctcagagaaaatagtctgaaaccaggtcaatcattttcagacacacgaaagagggatgaaatattaaccatagattgtagaggaggatttttgtggtttgtaacatgattggttatggtttttcaaatctaagtagcaagcatgagtccagactgagaaagcctctgcccaattgattagaattggagttggttcaggttgacaaagtgagagtttaggatgtgaagaatgactgaccacctataaaccaaaatttggactgaagttgtttcttcaaagaaacagatttctagaaaaccaatcaccatcatcataatcatcatcagagtaaacaagcatttaatctatctgattttatccagttttcctctgagaagatgccattggcaaatgaccagactgttctctacctttctacagagctataacttcagtcaagtgagtgacttgcacaagatcatacagttttatccaatatctcttatttttctacatttctacaattatcatttttttgatcctgaaagctaagtatgtagtgaaagtcatggaattcagagttgtttttattaagacacacttaaaatgaagatttaaagatccaggagcttgatttatcagtttaacattttaaaattgcctactatatatgcaattgcctactgctttaggaagtatttgatttttactagggtttttgagcatgtgtaaaacatagattatatctggagaccattcgtggtctctgtttgtccatacaaaaatccaacaaccctagctcttgataaaatttggaggcttaccattgtgaccatttgaggttgcatcttatatacatttatcttctgcattcatttacagtattcactcttagcttggaggacagtataatttaaaaaacccagcatcttcaaataatctgtatttagacaacacataggtcaaatctcaatataagctctgcttcagtgacaaggaggagccttaccgcagtgaagggaaaaatcacagaaaaaggcactccaattcacaactcttctatacacatctaggggtagttagggattcaagaggaaaaagcaaatcaaccaggtgaaaatggcaacaacaacaaaaaagatcaggtggctgttctgaaaaaaattaaaaggccctttttcctcctctcttacctattttatagattgaccaaaaaaccctcagtttgggttgtacttgggggttttgctcttctcatccagtcctgtgaaggaaattcacattgcacttaactgggtgatcagaatagagcagtgagaaagaaattaataagcctttgcaggctgaccaatgtcctattggggctcaaaagtttgatgggataacttggaaggtccagcaacttaggagagtttgaagacagacagcccccacccccagctatgttttgtatccaaaaagaaatttttgctagctgaattcatcatcatttactttgtcctcagcacagagactgcttgcatatgcaagcttttatttcaaaagggattctcttctgattttggtgtcactttatacatttctgtaacaagaaattctctcggcagctgtacttatgttagaaacacaaatgtaccttattaatgccagttatcaaggcaaagggtttgaaaatacttgctaaacatttgtttatttatatacaatatttcagagttttacacagctaaatactggcatataacaaacactgtgagtgtgtgaaagaaatataaatgattccagcagatggcatggtcagaagcaaagggtttgcaagtgcaagaaatagcacaaatccaaattgagaaatctgaatggctgtaattgtaacacatctacaatggaatcaagaaggtcatttacattacgttaagaaatacagaagcagagtcttatataagcgtgttacacaaaatggagatttggcacatgggttatcattggacagtgtaccacacacagtttttatttcggttccagcagaaaaacaatattgacaaatttctttctctctttgcttcctactttatcgaatagaagaggtaacaatagcatctgctgcagctggctggagcctgagatgaggaaattgtagctgatgggcctcccaagcatatcgacactaaaaagctcatgctacagccacggcacagccaggctagcactccaacgggagcggcagatacacaaggcagccactgtgaaccagagcagggcctgccaagacagcatgtcaagtaatttttagtggcctgaagtggtttccaccatcacagctccaggcactgccgcaaggcaggacaagtttatctatctctgacatcttctccatctccctttggcatcgctctacgattttctgctgcggtagcctcactgaccaaattggtacccagtgcattcagggtgctccctggctacccatcagcctttcttcccattattcatgggcttgaagatctgggatgcttaattgggtctaatgtgtcaaaattacctactccaatcatcttggtgtcaaacataacacttcctctcaatatacaggtgctttctggttattttcctaatgcatctagaaaatgttaagggaccctttaatcaaattgatttgaacaaaattttaaggaccatactgcagtggaaaacatactagacccgcagtctgaagacttgagtccagcagaagcctatgggaaagctgtcaacctcattggcctaattttgttttctcaactcaactctgaaatttaaaaaaaaaattaaaaaaagagaaggctgcaggaggggaagtggtctgagagtctggaaatgtcccttccacggctatgattcactgtgaatgaatcatagtcctgtttctgagttcaaaaagaggcccactagccccagtaaatcttgaattacaggaagatgtaaagaaaatatttttgagttaggatgtaaggagagttaagagcacaagtttctcctacccacaagctaatattttaccagaagtaatcaggtagcagttatgaaatgcatttttgagaatggacttttttcctactttcttacctatttcacatactattcataaaccctgtattttggggtcagcttagggggcttggctcctctcatcgagcctggggagggaaattcacattgtatttagccaggctgatgagcatggagagcagagttccaccaatccagtaaataaggttcagcaatgtggcactcagaggtagaataaatgaggtcataaatgagttgttgttttcccatccaaaggtggagtatgcttccccattccttgaatctggaatggcccctgacttgttttaaaccaaggaatgcagcaaaagcaattgtctcaaaaggccttgtagcttcccctttgatgtcctcagaaccctgagcccactggaccaggatgaaaagccttggggagaaagagagaccccatttggctttcccagcccttcaagctgactgagaaaaagagctcaggagagataggcagaagatccatgtcctgccccaagtcaacccacagacttgcgagaaaaaacaaattactgtggttttaagccacagtgttttgggttggtatttgtaggtagcaatgctaactgacagacataccctccgttctgccaactcctgtggcacacaggtgtaccagaaacagaaatacggttatagtattttaaaatatgattcaatgctcaacaccaaaacaaatgaacaaaaacagagagaaaagaaatattctcaaaataatcataattctcatcatcctctccctttcagacattaaatgaaatttgagcaagagcaagtggctgtttaccattggaatggaagagccacagttaatcctgactcattttatctagttctttttttaatatactagagatatgacaaaccatacactcagcaagcaccactgtgcactggtgaaacacttaactgctgcctctcccttgatgaactgcaatgtagagaagaattttggggggaagtggaagaggtattgagggaggtgagatgggaagagacagaaaaagcaagactgctcatgtcccttggaagaaagtagacaaaaacaaaaaatgaaaaatatttaagtttttcataagcaactcatctttggtaaatttctgtgatttaaaaataagtgtgctgtcccagaaatctgaaccctcaaaaatcaaagggcaaagaatttcaggaacctgcaagcttgaggaggcagtctgacattatgactcactttctttccattcatctcatctgttatctttggcctccattaaacaatgagaaagggacagtcactaagtcatatgccacttgagggcactcctggggcttattgtttggaactgccaaaatgctggacgtcataccaagtgtgaatacgaagcaatgtgactaatatcatagcacaaaagactagcatttatcaactccaaagagcatggcccttaaaactagccactttgagaggacaaagatttaatgcaacgctgccatggtgcaaaaatatttttggaactccttcttggcagtagagttaaacgcctacggcctgttcttttgaatccagtaatggtggcacatctttgtccttgaaagtggatttatttatttatttttctagtgccaagagatacctggagccaagcgtatggtttgtatggttggtgaccaaggtaagaaacactattagatttcttttcaagtaatgagcctagttctctgtatgctttaaaaggttataattaaagtaagtctcacaaagaagttctccaaatatttaaaataagagttgcattcaaataagcattttttttttaagttagaagctttgaggtgggttatcgtttggacccaataattctgccaaaattaaaaattagttttattaccataagcagtggttttcatgtaggggcgattttatatccaaggggacatttggctatgcctaggacatgtttttattgtaacaatgtgggggaagggaggtgagggtggtgagcaaagcccaaggacgctgctaagcatcctataatgtataggacggctctcatagccaaaattctacgatctaaaatgtccaaactgctgaggttaagaaaccctgcttatagaaacaattggttctaataagcaaagcatttattttagtgcaatgatataattataacagtacttaacacatttttccgtgttaaatattccagttgccacccatcttctatgttaatgtatacatgcacatgttttctactcttctgaatcaacaattacgtagaactcaaactcacagtccagaaaatataatagtattctttgtggacattaacagagtcaatttaaataactgtgaggtaaaacaataatttttaaaagtcagtaactgtaaacatttgttgacttctttctatgtaacaggctaatgaatcactttacacggctcttatttaatctttaaaaccaatactatgaaagaaataccactattatccccacgttactgatcaggaaattgagtcttagaaagattgtttaatgtgctcgaggtcacagatgcagtaaatagtacagctaagatttgaactctgtttgttagaacaatttcaattgcagagttttcactaccatacaatgctggcccctaagagcagctctatgtgctaggagccatctcatttgtaggttagggacagttctacccccatttgtaggatacacattgagcaaaatggaaaatggcagtataatatacacatagatcagaaagggggttctccttctgattccgcttactagttaagtacgttttcttcagcaaatcacttaacttctcagggtctcaatttccttagctggcgagtgaggaaagtaataatgcacatctgccactcttatcataaacatcaaataaaataagtgatggggagatgctctgtaaacagtcacttacaacacaaaagtgagttggttgctattcttaggcacgaaatgggaacaggattggtgataggttctcagttgcccttgaaggaaccttcatcaaatagacctgatatatgattttgaagttagatagtattgtattactattggcctcacctctcttccactgcatttatatctattatgcttcttttcaaataaattctgcatttcatcaggcagccagaatgctcttcctagcacctcaacttctccattttgagttttacactttatacctactggggacactatgcaattccttttaatgcttttttttttttttttttggttccattacttttaaactattttggcagaaggaagatatttttctatcataggactgtgccatcaacagactgaagacccagcctcctgtttttaacactatgttgtttcataaactacgcatttgcttcttatacagaattattggtgtatgaaaacagaatctggcataatgggttccacatggcataattatttttccttaccttaaaatgtttccataaataaggacataatttgtacactccacccattcttatcgagatgttggcatttttaacaatcctacctttcatctacagaaggctagcatctcctattccgtaatttacacataaagataaaccccaggtttaaggaaaacatgggtctatggttcacgtttgtcagcatctcaaaactatcacatgctttggcaatacttgtggtctttgatctgaagagacatttgaatggaacattagaagaaataaaaatggaatttagaatgaatggttaaaaatgtattaaacaattttccacagcactcttagcttctttggatcacaaggtcttttgtttttatgctcttatgcaatgctttccaaaatctttcttttgactttgaaaaggccattttcatcactattgggttgggcttaggggtacatggttatgctatgaatatggcctacatagtttcctggttgtgcttccatatgcaaagtcaaaaagtattatgaagattggaacttaggagtttttacaaccccaaactggcatctgattttttactgggccattttagtggcctgttggtgcttctaggaccttattgctctctatgtggtatgcagtccctattccttccagttctgaagagtggtttgattctatgattgtgatagatttaagtgatactcaggaagcttattttattttccttgagactgtttcacttagaagatcaattcaggagttgtgatctatccccttttcaatttttttcataaataaatgtttctcttatgaatagaaagtcttccttttgtcttaaaaagagttaatgtgacataagatttagtatcatgggtcaaggttttataactgattcactgaaattacagctttttcccaatgtattcattctagtatcatgggtcaaggttttataactgattcactgaaattacagctttttcccaatgtattcattcctaacaaatgcaaatacttagagcaaatcagttgtcatgtccctctggtactagaatatagtctttatagaatatgtggtttagaataaagccacaaattattctataaaacaacataaggaacaaggctcaaaagtggaacaaaacggccttagtttctaagtggaagactaagacgatataggaaaatgtaatccatgacctcttaagaaaatctcagtttaataaatagaaagttctgccccaaaatcacattttataaataagataaaaacaatactatatgtctctattcatgcactgcacatatatatatacacacacacacacacacacacacacacacatatatatatatgtgctgtgaagagataatggcaaatatctgacaacctttacacatgtgcagtaaagagctaagtataagggactaggtggtctctgcaatacgaagagtaagaactggatataatgatgggtaaacaggccatggactttgaaatcaggatgaaatgtatatgctgtatgaccttgaacaaatcacttattacctccctgtgcggaatgctctttgcaagcaaaatatactattttctggattaaatgactgctcagtaatacttggaaaacagtaatggctccatgattggtagctattgtgattatttatgttccagtgattaaagaatggaaaagactcacatgctagcaattgcctttgatttagaaagagtgaaagaaaggccagaatatagcaatgtggtatggaatcagaaaggaaggagtggctcattctgaccaggtcaccagggaaggcttgacagagaaatcagagaaatgcccccaaagggacagcagaaaggggagctaaaaaccatcatgggacctaaagtctggagaatctgcctgatttatagggccatgcaacatggggaacataatggccttgccaccactagtagtatgagctcaggcaagcaagctgatcttacctggcctctgctgttttttcttctgtgaaatgggagactaaaattactccttgtaaattaccacgggaagcgaaaagcagtaacacatataaagcacttatgacagggcctcttcagttggcaagaaagattatttgatgttgaataagtgctcaactatcctgaactattagtattgctacaaaatggggagctatgtctaaatttaatcatggaatagatggtatgtgggaaagaacatgaaatgtagagtggtagaaaaaggaactcagaaatagttataagtaaggcaaaggcaatttaaaaagtaagctctcataaagaaataccccaatataaagggaaaaaaatatagtctctaaggtgaaaacacaaaccaaaaaaatcagtccagccttgaaactcttactatttttgtaaaaattactaaaatgccatatgtaattcaacaaacttggacaagcaattattgagtgcttactaaggtgtaagagctgggggtaaaaatgtacataagccatgactcatgccttctgagatctcaaggtacgtatgatctgcacacatatagctaaacttgcacagtgtgaacctattctatgagaatttacagaatatttaattcttcctgtgggaagataaatggggaataagcttaaaatgtttctccagagttacaactcaaatgtctacaagataaagcaatgtcataaatgtgtgtaaaacaatagggagtgggaagggtttgcaaaactggatagtgcattccagcttaaagaaattcatgctcaaattttaaaaaaattatcgtgtatatcaacaaaactatctgaagccagtttgcaacctctgcaatacaaatagaaaatgctatttaagttggattatgcatcaaggttgaacaccatcaggtagagaaggggaattgttgaaattctagaccagataaatatctttggctgagatccagagatgaagatatttggaatgtgtagctatcagaagatggcccaaggagtcaacaatgaggtgcgaagggtgagatcagcctaaattacaaaggggcatgaatgcaatgataagcagttcacacctcatcttgaaggcatcaaggacaatggcattaagttcctttaacagcatcattttaagagttgaaaggtttctcaggtctttatacaaacagatgtattattataaatgatcctctctaacacatagcatcaacatgttctctctcactgagaaaagtctcatgggattgccatagtagaaaatatgtacatttgaaaaaatccattcatttaatgatttggatgtttataaacatctgttatttaataaaatggatggctcaggttacgtagatgatatccaaattcatgttgaatttttcttctcagagttctaaatatacacacagcttttaaaaggtactcagtaatgaataattattaataatttaaaattactgcatacttctatatgccatgcactgtctcaagtgctttatatgtatctattttatgtcatcttacttaatttttataaaattctcattgctatagcgttatcccattttacaggtgaagaaacagagattaaataatttgtccaaaggcatacagccagtaagtaaacaagctgacattttacttaggcagtctatctctccagagtgtgtactctcaatgttgagattctatgctctgtatgaactgatagataactagagttggcctttccttgcttgcctgtttgaactagaccttctttcttttagaaatctggtagactctgtcctccttgaccttccaaggccttgtctgcgcttgttgcactaggctatccctaaaattcttttttgttgttgattgttagaatttcttttacttaatggctcatttttgtcttagtccaattacagcacagaatcattggaggaccataatttcctttttctgtactgcaccgccagcctgaccttttttgggctactacctgacttctttgaaacctcctccattctcacaggatatattgggcagaaggcttggatctactttgtcactacttctttaatatagaaaaaaagtttagtacataataaaagaaatcacaacacaaaatacagtattcaccttccagactattttttgtgattatgtgtaacatgatcatgattaaccgtgatcagtatccctttgtaacatggctattgtggctttttgcatagtttctttctgctcagaaatggtttctaaactagcatttctgggatgctacacggataactgtcatttaagaatgactttaatctgctgctttgtcacaaaacattatactgtcaagttttaacttggcttgtattcaactcaaggattcaagataacatggatgttgacgatgttgacatgaccctcctaaataaagaggccaaaacttcttaccagacatgtaaaattacctatgggtaattatttcacagagctcagtttatgcagttcctttccctcattgtttcgaagttgctaacaaatttcttccaccaatatacctactcttctgttgtttgtttcaataagcagcttctccagagcctcaggcacagcacttccaaatgtcagcagctattagctcagcacattcatctttgtttccttatttctcctgagtagcctgtctctctcagaggtgagtccaggtggcttaacataacatggatgcgggtgtgtgtgtgtgtgtgtgtgtgtgtgtgtgtgtgtgtgtgtgtattttctcaaaataaggcattacagctatttaatcttatctctcatatttgctatttgcttgcaaacatttttgtatctgtcacggtgcctagcatgaaacccataccttgcttataatctacagagggtgaaatgcattttaaaaattatgtatgtatgtatgtatgtatgtatgtatgtatgtatgtatgtgtatgtgtctgtctgtctatctatctatctatctatctatctatctatctatctatctatctatctacctacctacctatctcagttttctagtgcctccactttaatttacggaaatgggaagaacatttggagaaagcacagattctgtattttgaaatgcaatgtgaaaaaaatcatcatgctgtttttcagtgaaaactcccaaattatgtgtctctaatttttgttcccattattttaaacatataattacacacgtgtctgtgtgtgtgtgtgtgtgtgtgtgtgtgtgtgtgtgtgtaccgtatttttgccattaggcatataagggcaacatttcttctgctagaccaaattttctgtttctctatcctttggccaaactctatctgaaaacaattcatgtgtttcatgtgtgatttttataatcaaggtcagatctgaccaagcagaggcaccatataatcaggtacattggctctttgaggcctgcaaagaactgtgagcatacagactgatcaaactagcacctgaattaaaaccaaaaggcaggagaaccagaagtctactttcatgatgtaaaaccacttgctcaaattaaaaataatttttaatgttttacaatcatgcagaaaactgcaactggagtggccagtcctcaaaggaccctgtcttggatgtagggaaacaagaatctagataagacttgaggccgattacgccatcaccttcttagttatcagtacttgaagcaaactttgtagcctctcacttctcttgacacgacataattctcttaacccaacatactgttgttatgaacatcaaacaaaataaagcataggggagtgctttgaaattagtaaaatactctccataaatacaaggtaatgttattactagtttttatctaggaaaacatttgctggaaaagagaaactttatcctgtttggaacttgccagctcattgtttaacaatgagcattgtagcatggtttggctaggtgaatttcactgcttttattctgatcagcccgttgaccccatttctaaaaaactagctccttttctagggtctactgtattatatttatattatagtataatatggggtatgaaagagagtgatggtattaagtcacgatagaagtgatttacgatagatgctttcttgggtttttcctatactcccagacttctattttacttatctgtggaagaagcaatattttctcatatttgaatttctcaggttataaagaactatcatgaaattatatgcactatacatttatatagtaataaatagactctgaccagatagcttgagtagtctgctaataatgatacttaagaggcactcaaacaactggaagaaatcagcttaatatttaaaaatctataaacatttatatatatcgcaatctgagtggtgatgtagctgttagagttaagcaaaaaatacaaactatacatttcgagagaaatacaacttattacctttgagtacataaaacgacttcttccaaattatagaacttgtatatattctattaaatacatttttaaaaatcaaattagtgatttgtcatgagacttgatattactaatgtacagaaggcatctttaagcaataagatagtctccctaaagcttgtatgatatattattattttgttcagtaatttttttcccctataaatagtaaaaaggttgtatcagtccagcccacaagaacttgtcaaacaatacaaatttgtttttaagaatattcccccacatattattttttgttttacatatttatagccatgtgcccacttaattttgtgtttatttatttctcttcactgggaaaagacaatagcagtggaccatagctacctactatctccaggggaaatatgcatctatgtcaaatccatcctattgatgttagcataggcctcatttgaccaaaagagagctgtattatttatgaagacatttactattccagaatgtcaagaagttgcagaaacatccaatgagagtcaatttagctttctgtttcctgactgcaagtgaacaaacgcttcttacctgcagtgcacaaccatcggaccagcatcgggagggttacaggttttgactctacgtaagaaagctagaaaaggtgtagggtgttctggaacaccatgatcaggccaggcggtgaactggaattgtctcacttctctcttctcacttgaaccattctgtgaaataggaatatcagctgaaattctgttttccaagcctcaggtggtaatgatgaataacagggaagaggtaatgctaaaatgtgctattttaattcctttctaccaccctgtagcctttgggaagacacactctttggaaatagaaaccccaagctatttgtaaatgacaaatatttgcgcaggaagacaaaattcttaggtgagaagcattatatttttcaggtttaactaccaggagagctcctatcacattttacaggaagagctagttcttcttcatctactcttcattggctgaaactttcatttggagcaagagttttatatttactgataaatcgccagacaagaagaaaaatggctgagtgataatggaagatctatttcattcttcactgttgccattgagatcaagatttaagtaaagccttaagagatttcatttctcaaaagaagctttctttaaacaatagagaagggaaagggaggagaaaaagatgaaaagcaaaccttgtaaagtgcaaatgttcgaacacaatatgtggccagctccacagtatcaagcagcgttacttgaacgagtccgtgggtttctgtgcctctgctaggccaatactggtcacacttcacctacaagaaacaagtgacacattcagggcaaatgctcatcaatttctctattaactttgctttgagttgctgttgaaggaaaacagcttttctgcacttcattttatgttgatctttttctggcatgcatttttgttatcccaatatatgtaaattactgctctgatgccaatataaaccacatttttcaaactggtaggaatactaaacagtaacagattcaattttcctggagaaaaataagttgcagattgttgctgggtaaaatacagagagagggatttgaaacttcagtgagcttgaagagaaaacaaatttgtcctgggatagacgttatgaatcacatcgggaggatgacactttgtcatttaaactacatggtaagatagtgttacttcatcaagatttaaaaagcacaacttccaaatatgcttgtttaaagaaaagtagaaataattggaaaatctatcaaagtataataaacaacataagcatgtgctttttttttgaacacaagataaatgttatttgtatccaaagcaaattaaacctataatgtctgcaggaaaaagagttgtctgttccttaaaaagagtctcagagggtcacacactaacagtgcaaagtttaaataatttaaaattcatccaagatgaataatctacaatttctatgtgaagtggaacaaaagcacataaaaagttttcagcctaattagtttaacacacaacaaagaataattccaagtctgcagtaaacctcaaattcactgaatgagtctgttgggcattaaaaagtataatgaaaagtaacaaacacagcacaatatttttggagtaaggccatagatctgactatatttaccctttctatctcagacttttttttaatgggactaattcttaagagaacccaactgaaatacatttctctaggtaaagaaagctcctagcagtattttacaatagggaatacacctttctatttgaaaaagaacagaaaatcacaatctttggatttaaacaaaggcaataaagcattattattagagacactagaattttttgggtccagcaaatagaattattacataatgatttgcttttatgtttaatatgagtatttgtaacattctgtgaataatactgtaattttctctttcacagagatagcatttgctcctctgagaattcaggctctttccatgaaactattggcccttctaagaaagggagaagttttatcctgtacagaatttcccagacaagacaaaaaagaaaagcactttatagctatacagtaagctagatattaaattcacaaggtttgattcctatgccttgatttcaactttgagaccacacaaacatcatctttttgatgaaaacaaacaaaaattgtccacagtaagacaaaaattttgccttaataagatgtaaagaatattttgtgtgtttcctagttgtacaaaatagccttctgtgttttttatttctatcatttgccctgactcaaagagataacaacatagggaaatgataattcttgaaggagaatactgacgtagagtgaccaggcatgggcatctctatatgttctttcaccataagctaaaacccaggtcacagatgacatatttagcaaaagctaccatctgaatagaaccaacactacttcagcagtcatgatatagatgagaaaaaaaaaattaacaaaaattatgccaaaggctttgttttaaaccatgaaatagatgtcaggtggatgtctcccagcagaggacaagaggaactctggaggcctcatattgtaatattcaagaagatgccaacaatgggttgagttgaagattcaagagagaaactcaaattcatcatttaacagtctcagctggagagcaaccctttcggtttaaaataaactaatgaaatccctaaggacaaatatcactatgatatgcacaaaaacagcacattaatgcaacaaaatgatctatacagccagttcaatgcactgaaccaaattcaatataattatattttaaaactgggactcgattacatttagaccttctagtgaggtaagaaaaggagatgaaggaaagaatgagaaggcaaccttcatacaacttttggaaaaatgactctccatctacaaatcttctccattcctaagatgcaggaagaactaaaattatactaatccttacatttctagtaataagtttcaaactgcaactattattggcttagactctgacccctttagaaaaaaaataccaggaagcattactgtaaggagtaaacgctgtgaaaatttctagctaaaagaagaaaaaagttgcttttgaacaatgcatttttagtatttaccaaaagaaaaataaacatttcaaactcaactgcaaaaatcagaggcaattttttaaagcggatatgtctaaatattaccattttctctcaggaaatatttctcaaaaggaccttatgaaaaataaatatcctaacgtatgtggaaatgcacacacatggcctcagcagtgggattagaagcttttcctgagcttatctgaatagtgacagcaatacatttttccctttgctggtaagcacctcagtacttcctttctcgatctcattctctgagtagcctgcacaccttcatctgattttggagggctgaatttaagggcttagagttactgacaaatattattttaagtctccttttttgccatatgctaaacatatgatttctgatttcagcattagggagcaagtatgaaatgtagtgagaaagaaaaaggagaacaatagagatattttttctttcctcattagccagtataaatgaactatctccattttcctctcttaaaatgttttcctttgacaactttccttcccctactcggtcttcttaagagaaaatatcataaggtatttctagagagagttactatttgttaggcttcacacataaagctgattgtgagatgagaaatgaaggcagctccctttgagtacataagaactagaaggcaggagctactgaatacgaatacggttttttgcctttttctatttgatttagaatggatacaagcggcctctaggactgattcatggaaggtcaggcagagtctccctggatgcctggaaaattgtttctctgtttccaggaccaaagtctggccgcctcatctgtgaaatgggaacagtgtctccagcattacagagctattgtggggattgaagtgatgcccctaaaacacttaacccaaatggctggcacaaacaggcattcaacaaacactagctatcattggttatcagtttgatgacattctggatttttgtgtgtggggggttgttgttataaattacctaaatcagtctaaatgtgaaaaaaaagaacatgttattaatttcagcagatactgatttaggattttctaggtgcaaagcaaggtgttagcagttgtggggcatcaaggtgacataagacccagtccctgccctcaatccattagccttactgactaagtggggtgtttctaaacctccttgttcttcaaataggtggttctgagattccaaacaattctcttcatctatgtgggccccaatgtcttctgaaaagagtatgtgttcaactcagaggtggaaaagaagaacagcagaacttgtcactcaggctgtggtttagaaacatcacccagtaactttacttgaagcttaaactgagacagttcagatttttggctaaatttgcgggaggcatttcttttcattatcacaaagttattacccttaagtggagctttcatttttctataattacggaaagaacagggtgaccattgctaaatttatgcaatggaattaatttattttacctttttcatgacaaactatcaaaatcaagttgatggaataataaaacatatttaaatttatttttaaaactcttgtcattgcaaatatctggtaggagctgatccattaggtctgctgaacatgctttgggagaagggctctcgttctaggctatttttactcccatatggcttaccttgggagtgctcagcatattgtaggcacttaatgagcggtagccaactttataatcaattaactagattggcttatttttaaattgtctaccactttctgaaaacaaaacctcctcatctcaatttaataaagacttactgagcatggcaacatggcaaggcatcagaattccaactgtaacaaactgataccttgaaagggttctagcattgctaatccaaaacgtatttgccacgagattatttagccaaagaaggacttagaagaggcaataaatgatacgtgggataccataactattgctaaaagtgactctaaattcgtacctagtaagtttgggcagagtggttgttcaagcattagtatcctgtaaggaatggacaaacaggctaacattagataacacaagtcacagttatttttgggagtaaggaaatgttggtacccttttgtcaatacccatttaatgagggagactataataaaggaaagttttagataaatttcattaattttagtgggcagaaaaaataaatgctgaactatttatttctacaggttatagtaactattctggaaatttttaagaccagattgaatacttgattttccacgataaggacagagagcatctcagtgattctcttttaacaacagtgtagttctctgcactcaatcaatatttggctatatctattcccaactggcagtcagtctggtttgtgtattcccccattttattatatctttactaatcactatttagtggaggacaaagaggcactacaatatttgaaatgagagtgatattaaagcatttgaccaccagtgcagcttttcatatatacagccataaagttgaaaaatattattctcaaaataaaccaaattacatgtcataaaattgcctaccagttcattgaaccattcgcacactttctaaactgcttattaactttaaaaaagttattcccttttgtttgatgtgtctgccagaagttgacatagggagctgccgtaaacttttccaatgacttcccccattaaactgaaagtcattaagtctcaagtttctggcactttgtcctaaccagagcagaactgtgtgaggtgcctctttctcgtggccaagtagcactttgatatcagctcttcccacatgaggtgggtcctcagagtatccacctcagacctaatcactcctgaggatcacctgggtgccccacatagccctacagccacctctgcttctgccttggtctgcccagcagttgcctttgactccagtgtcacctcttccaaacagtatcattagatgactcaatgtttcaataaaaatataatttataggtaccagccagcatcaatgcagttcaatattttaacaaccagtacaactatgttgggtatttaccagttgaacatcagcctttccagacattctgctgataaagaacagagaaaaaccaaacattggaccctaaacactagtaaacagagattaacacatacttctgaaaactttagaaatgagacctaatccagcacaggagaaccacagacatgaatgcagagaatgagagaggctttgtacaaagtcatcaggagcaaagttgcatctcctcctcccattccagctctttactcaggtcatcaggactctaactggctttaagaggaatgctttgagccagaatctgtcagctgcctttctaagtagagcaggtggggtggggaaagaaggtagataatccagaaagctaacaaacagcaagaaattggtgggattctttctcttttatctgacgctgtgtctgctgacaagagaaaaccaaaagtgtagaactttctagataaggaccccaacatcctttagattgccaacatgagcatcattctttttgttgccagcgtcctatttacattaagtatccaccactttcaaaaacaatcccatacatcatgcagactccaaaggcaatgtttgtgctgctggtcctaaagttgcttaaggaaaaaagcagtttctgttgccctagataggcagcactttaggctgcagtttgagaaattaaatgttcacggcctttggcgcttccagttccatttggaaaaggacacaaacctggcatttggaaagcatttgctctccattaaacttaccgaaccttgacaaaccagaagggccaagaattagtctgccactggccaaggctggactttccaaaactgataacagcaatgaaaacaatagcactgccatttataatcttcaatgggattctgtcaaattttaacccaaaaggatctcacaatctgaaaagaatctcaagctttgttttataggaaaagaagaaaatgtttgagcacaatctctttttctactgcttcatgctcagaattgcccttttagccatagaacaaaatgtgaatgtctccacctcaccttcactttgtgctagggtaagtttactaaggtgacattcaaggactggggaagacataggaggaggagtgagtggtcattaggtcagaagtgttccaccagccaaatgtcaagttccctaaactgttaacaaagtgaagttaacaccagcccagtctctttggccctgacagcatctaacctgcattcattagcacaaaccacaaaatttagtagggcaggaattttcccattctttggcctaagatagaactcaagtcacgatgcacaaaacatttgatctgctttactaatatatggcatcatctggtttgtatgattccctatttggaaacagaaaatgggacttaagatagcttggaaaccaagaattaggattcttcatttctagccctatattttcactactaattggcacagcccacattggattacaataaaaatcatgactgatttgttaagtgtcaaaatttcactccccatctccaacatttataacgctaagtacatttacaaacagctctttaagtgaatcaacccccactataaagcttgcaagacaagataaacattgagtctctactatgggcaaggaatgaaggcaagctggtgaggtgaagtaaaagtcagatatattctaaccctgactaagcctttcaactgctaatactaatcagggttactcaagaattttctaagcatgaggttgatgcattctctctgtgttctgtatttcaagatgggagacagagtaggagagaaacagtcaagagaagatagatgaagggaaaaaggtgaacactcacacactaaataataatttaatatacacttacttaaaaaagcagatgaatcctacctcggagatgccaattctgcaagcaaggctgccaatcatgtgccccagtcatcaaaaataatatccttggagtggaaatcccagctgtatacattttactttccctacaaaatgcttcattttttccaaacagtttcctccttccatgtggttgcccagaccaattcgtgtgcttattggcatgttatgaaacatggaaacaattagaaaccacattctagggaactagaatgacttgctacagaatcaatgaactacgcaaaacttgagaggatttggcaataaagatggaaactagggaaaaaaaaccactaacagtatttcatattacacagtacattctacaacagctttaaactgatctgtgtgtttcagcagaactcatgctttcccttcaaaatctccagcttctatcattgtttttttgtttttgttttgagatggagtttcactcttgttgcccaggctggagtacaatggtgcaatcttggcccaccacaacctctgtctcccgggtcaagcgattctcctgcctccgcctcctgagtagctgggattacaggcgtgtgccattatacctggccaattttgtatttttagtagagatggggtttttccttgttggtcacgctggtctcgaactcctgacctcaggtgatctgcccgccttggcctctcaaaacgctgagattacaggcgtgagccaccgcacctggcccgttgtctttgtatttctttatataccctaatgaaactcatatgaaatattcaacttatacttttccttcagggttgatagctgaatgtatacaccaggcaaagagtcttctcagttaagattggaattctttaaaggccacatttgaagggaagtaatagcatttgaaaatcaaagaactcatgttttcaaataatcaacttaagtcctaagtcatagttcacacttataagggtttctttagccatgcaaacactaagaatgatcagttctcaaaacagatgctagtgaaacttctaatacctgctaaggaatccagaagccttttgtctcagtgagctgttctaactcaccaaaggtattaatacaagcgctgttgataaacctcagacctgagcgacagcttaagagtgagccagccaggcacgggctggctcaagcctgcagtccaaacactttggggggccaaggtggaaggactgcttcaggccaggagtttgagaccagcctgggcaaaaaagtgagactctgtctctacaaaatctaaaaattagctgggggtgggtgctgtgcacctgtagtccctgctgttcaggcaggattgcttgagcccagaaatgttagattacagtgaactatgaccacaccactgcactgcagcctggacaacagagtaagactctgtctctaaaagaaaaacaaaaacgagtgaaccaggctgtggcaaaacagaacgcttgaaaagagagatgggctctaaggcaggacaatttcgtagcaccataaaataaccaaaaaaggggagaggggatgtaaaactgaacaataaggaaacgtatcttcagtggcacttatcactacatgtaacccatgtctatatcacttatgattttcatgttgtattatagtcaatgtagcagccggaatgttctattttggtctgttccccggctgatctctattctggagatcctgtcctgggggagagcaagtaggaaagaatcccatggtctgagctcctctctcctcttgaataaaatgcatgggtgtgccacactgggaaacgtgggcataattaaccatgttcagggacatggagaggttggtcaggattcatcgtcaaccatagagaaataaactcttttcatttgggaacacagagtgaattatttggaggctatcttttggggaaactgaagttgtcactgtaaagcccccaacttctttaccaaacaataccatttgagactcactgagccaccttgccacatcctttatctcagtcaatacccacaataacccttccgcataatccaaaaaaggaaaaatgagaatttgaggagtcaagtaaacttgctcattgtcacacagctagtagaggctagagttggtatttgaactcagacatctgactgcaaagtgccctacttggaactgtcccatagctgtcctctctcatggtggtatccccatgcagtcctgcgtaatatcaagctatcttctcttctctttccttttctcccctcttccctgctgcaaatctatggtcagtggcagtctagcatacttctaattcacagcagcatttacaagacgcacacatattttcttcatgtaccataggaatgaatattattttaagaacctgagccttaatctaaataatgacatttcaagcttcagctcttggagaggtaatttgtttacgttacctggactacctccctttatgaggaagactggtgccacttcccttcatagggccaggctagttccaatgtctgctttgaagttggctgctgggaattgaaaattcactgagtcccaaggtcagcccacagaacccaccacgttcctgaagtctggagctatagatttcactaacaactcacccctagttataacattgtttttatagtgaaagccaattccagctcttgtttgggaatccaggaatgccttctcctttcttcccgctactttaggtaaaagagcaactggatagggaaagggtgagatgggaatgatgggagggaggaagacggaagagcagatgaaataatatgaggctccagtgctttgttaaatctctccaggacatgtggtcatttagtcccaagtgttctggactggagaacaaaggacttttgggccttggggtccagggctcatgtgtattgtcagattggtggtggctgagactccccaaatgcctattggcttatgcaggtcatcacaaatctgggtacaggctgaaccaccacagaataaaaatcacaagacagcattttaattggcttccttaggccatttaacaaaggagaaagctaacttgcaagagcaaagagtaattaatgaagggagcaaacagaggttcatttagtaacttccaaataagttcctctggctgaggggagttgggggagaaggtagcctgcaacagaaagataaactgtaggtatttaagtcacaatgccttccgccaagaactgctcattaccatcagatgttgcagtggcagtggggccagttagaactaactttattattagaagcaattagggagaaaaggggcagaatttcatttggttatttcaaaacaagtttctgtgcacagtttaatgaaggcctgcagtgtcaagataaaatgtgtgttttactgaaaacagcttttgcaaatgactgcttgttaccagcagttatctccaggcagaacagactgggtaggttggatttacatgcatgccgtaatataatagttcagctgtctcagtttcacagaagtgtcaacaggcagtatggcttgatggtgaagcacgtgtgttctggagccagactgtctgtcttcaattcctatccctgaccttggtagctgaatgaccttgggcaaagcttctgtaatgttctgggccccagtatactcatatgtaaactggaggtcacagtagtgtttcttgtaaagggctgttatgaaatatcaatgcacctaatatgttagacattattatagttatgaactattatatccaagatcacttgggaggggagttgtttttaaagaaactgcttgatatataggagttaccttaagtacaaatcagtaacaaatccatttacatcttttgaattgggtttgcatgtaaagtatggcagatatttgtcttcagtgtcatttttatcttaattcccattttagacaatatttcaacatctctatacaattcagatgttttgaaaagatctaattgctttttagttttgctaaaccaaccatttatcactgcttttgatttcccacctttgaggttacagttgtggctttttaatatgtttctgtctgagcttttcccttataaatctcttgggcagcttttaaattgtccctcatatacacgcccaggcttagagaaacttccatgtgttgagcttagaagaacatttacagaacctcaactttcacacagtaaatggggaatcaggctttcttccttctaaatatcctttttgagactactataaccacagtaaaagaggcctctcacttgtggtttcaaattctgtcttgaatgtccctattcttcaatgaaagtatctgctgtcttcaatgaagtttcagagatcccatcattaatttctcaaggttaaaggttgattttcttcagatgctacaaaatgtacacatgtactcaggaatatggtatactgcttacccattattttttagtccttcaaaccaacagcatttaactaatgtgccatgcaccataatattggacccatacgatgaataaaactcttttcttggaccttaccaagctatgactccattattaaaatctactcattttggagaagtttaaactagcaaaacgccctctatgcatttatgttttctcagccgtgtattcagccacatcatttttccagctgccctgacttaatttatactaatgtgaataatttaagcaaaagcctctttcacagaacttaagtcttatgctgcagattttaagaaagaaaaagttgaaaatagtggaagtacatattggtgggattctccccaaagcccgtaggttcttgttcaatggtgtttttgaaagaggttcaagcaaatatttattttctctaatcaagttgtctattcctgtgaatattccttttttttttttttttttttactttttagcaaccacacacatcataacatgggagaatttcttttgtgaaaacacccagaggagttttaaagaatggtttaattagagttgttgatgcccattcataattagtatctgttagaaagataagccttagggaaaggttagattctgaacagaataaaatatgcaacatagggactctgagggaaaatttttaaaaggaaagaggtggatacttattcttacccttgatctttcttctagttttgtcatcatgacaactgtggcactccgttgttcccatatcattctccaaaagtccccaaatgtttcggggagagatccctgtgttgcaatataggcattttgcttcctatacccatctatgtagttggcattcacatagtcacttcctgggatccctggaaaacaaggagtgttattcaaccaggtgagcacatcacaagaggaaacagcctgggacatgacctaatggcagtgctatcttactgttccacctcacactagagaagtcacaatatattgaaggtcgggtttcaagcaagattaaaaacaggtcctattagaaccgtcatgttaaaaaaaagtatgcaaaaaagtgtcaggtctttataatacgacaaagaaaaaatacaatagatggtccatagaatgccttttccttcactggttgttggttttctctgttgcactggcaaaaaaaatagtttccaaagaacaataaacaatctggtaacattcctcacccatgtgcttcccaggcaaaaactagataaaagaatgcctgagtctgaaaatacaaaatagagtggaacacaccataataatgaaaaattctttgtagatttagttaacaggaaactcatatataaactcatttaatatttacaacaactctgcagtaagtcctgttatgagtcctgtcaggagaaaactgaggtgcaaagaagttaaagaaacttgagcaagttgctcaagttggtggaatcaggtttaatcctaggctactcgtatgtgtcttgacctctgtaaagtattgcttctcatttaaaactcgtgatttgttgtaagcagcacatgaacctcctggattaggacagctgccccctaattggatgtccatcttctacttttgtcctctccagtttgttctccatctaacatgagagcagttttaagaaatttatttcagacactgtaacttcttcaaacccaacaatggcttccccttatacttcaaataaaatccaaactctgaacatcgcttacaaagctctgcaacttcccaaactcatctcattccactcacctccttgcctttaaaactctagacactggtctgcttcaattattagaaaacatttatttccctccttagctcaatccacatcctagaatatactctgtctccttcccatcataaaacacccagccgccatcccagaaggcctgccctggagtaccctgagacatcagaactcccttgacagccctttatactactgattaaggttgtaattatatatttacttgtctgttaagttgctttattgcctattttgaccatgtctcttttattcacctttgctaccctaatgacaaaagagtaaataattttccccagttccaacatgtaatcagtagcagagatgtaatttaatgtagatattgtgatttaaagcctagttttccatcagcacatgcctttaagagagacagaggcaaatttgagcttcttccaagaagaggagccacagtgattaagggaatgaaagctactccataagagaaagaatgcatattatagcctagcaaaggaaatggtaggaattgggataagagctgcctgtgagaagaagagaggtttagatttactctgttgagttccaagttttaaattctgaaagatttaactacagaaacatgaatttcatctcaaatacaataaagcattttcaaatggtcagaatcaaaaagggagttaagtttccttggaaggtcatgagttggctatctgtaggggagaacaagcactttataggaatgtcagcatgatatgggaaggtacactagaacttgtgcatgatcccttctaccctgggaaatatgaatcttggaattacggggtaaccattttttttttctttataatgaaacatatgttcccaagctcaaattgttatatttcactgattgccacttgcaatgactttgactgcttttctgattccggttgtaaagttgatcctctcaagaaaggtaatgaaaatcagatggaaactactgcactctgagatgaacacacggatatggaataccaccagcattagttgaaaagccttttgagcaaaacttgaaatgcatggttggctgtaacattattcatctattacagctactcaagaagcagttggggttttggcagctctttgttgataaagatcctattcctccccaacaccagattactgtagattcaaatgacggtttaaataaaattctcaggttacaaacactgggacgtgcacacatcttacatatccataggatttggttctgagtcaagaatgaatccatctaacaggaaaaacctactttcaaaactttaatttagcagttagcaacattaaagaattgataaaaaggattctggctaagggcctcactcagctgccaatatacagaaaacttttttctaagaaaactcagaatggagaaatctgggctaaatgactcagaagattcatcacctgggccctgtgccacctccccccttatcaaggaaagcaaatgtgtctgaacaatgcatctgaggatggaggagatgcacaggagaatcattcctaaagacagggaatcagacccatccaaccctctttgggtaaaaatgttaatcagttattatgtaatgaattggggttttttgcatactgcccaagtttgaataataaattctttttgtttaacaaggagggggtaggctgctactgaataatgattgcacttcccaggataagaatacaaaaatgttgcctgaagactactaggcaccaggaatcaatactatcactaaatgctttaagaatttaggaattgggcaaagtgtagtaattcatgcctataatcccaacattttgagaggctgaggcaggaggatcacttgagcccaggagtctgagccagtctgagcaacatggtgagaccctgtctctacaaaaaaataaaaataaaaaattaggctggcatggtggctcatgcctgtaattccgacactttggggaggctgaggcaggaagatttattgagaatagcacatgacaagtctgggcaacatggcaaagagaccctgtctctacaaaacactaaaaacttggctggatatggtcatgcacgcctgtagtcccagctacctgggagcctgaggtaggaggatcatttgagtccaggaagtcaaggctgcagtgagccataattgcaccaccacacttcattcctgggcgacagagcaagactctgtctcaataaaagataaataattaatattctgaaaaatacgtaattgaaaacaaaatggaatacctggtagagcaaattattaagccaatgctttatgtcctgaaaataatgctaagattcctcttatagtttgatacctatttgtaagaaggtagtacatggaatgaaagcctccttctggcaaatctctttacgcgctctggtgaaaagacatttcaggtaagttctctctcacagatcctctgcaaatgtggagataagagagatggctatgttctccagaagctctaagatctaatgagtcctgtattcataaaacccaatataacacactgtgcagaaagatgaaggagaaaaaattttagaaaggatggtggtgtgtcctaaaaatattaaccccagattggaagctaaagttaatcagcagtccatttcaagtagatgagactctggtttttaatgtgacatatttagaaagacttttcaaccaacactgtgaaaataaacaatatgctgctttccaaatgttttggtgccatgaaatgcttcttcagtagttcttgattaggatgtttctgctgggaggctggatctaacattcttccactttttggggggtgactttctctaagtagtgcatatttatttaattttcaattccctgccttttccaaaaaatgatttgcttctgctaatgcaacattaatcagagtgcacttctaatccaagagaagtgtgtgagaattaacttaattcctttggggttatgaaggatggaaatgtaacttgaaatgtagtactgaaagagtatagaattactataaattaggtgattgcttttcattcttggagtcaaggagaccttcctccaatactagaataacagtgcttgatttgttttttgggtttcctgtttgtttgttttttggttggcgaaggagctattaaaacaggaggaacatgacaaagatgtttgccttctgctcctcataagcaaaattttagaacacattggccctgctgcaggaactctcttggagtcagttggtcttagtgtctttgttcaagaacagcttacctctaagactggttctttcctaggagtccatggctctactgcatttataaaactgagtgggttttcatgatttctcatgcattgtttcatgtgcattctctaattaataacagtgatgtcaatagttgtaaccccataaataattgtttagccttctaatcttacacatgagaaacctaaggctagaccctctaacttcatattataccaatatgctccattcctgggttaaagtgtatttcctcagttaatgaactgttctttcttgtggcatttaaaaatattacttacatgctttatactgggtctttgtgttctgggctaactaaacctggctgttaatgcaagcctgtaaagccgacagagattgtgatgaggtgaatgattggtagagctgtgcttctgttgtttttcatgcacaacaagccatagcaaacagctatttgaacagaattaggcacgttttaggctctcattttatttgctgttgattgctagttacagttttcagtggaaaaatgagcctggatacagactttgaataatggggtcatgtggattttttaaaaccaccaagaagaaaaaaaaaagcaaacaaacacccaacttgctatggatttgatttttggggccagaagataattcgatttgaaaagatgtctcttgttgaaggggtgtttacaatgatgaggggtttataataaagccttaagtcctgatattaagtgaaaaagcaggatgcaaaataatacatgaattattttgtgaaatcaagtaatcctaaggggaaggatcataattttgcatcacattacactgtaggtaaagtcacgtgtgcattttaaagtcttgggacaatagcaagcacttgctaagaatttagagaaactgaccaggaaacctggactcctgtctagggctgctggtagtttactctgtgatctttggccagttactcaacttgcccagaactgtaattgtttatttgctaaacaagatgtgttggacaaactgatgccctccagttcttttgagttctaaaataaggtgtctgtctgtgctattcttaaccttcttggactcagacatctctgtgaagttattttaagataaatagaggctttgtgtctctcagattaggtaggaacgcactctgatgctctttcaagctgattcctattgcttctacctttgatgtgctgagatgagatttttcactgaggctgctacttcacatcttgattggaacctgatggggcaaaaaataaacaaaaagcaagaggaagtagtggtactaggtggtctgtccatggaaagaagctctccttggactttagcgggtgataataactaagaggcagtcttggagggaaggcagaatcccaccgtggctccagtggatgcggctgcactacagagatggagatggatgttcagctgagcgtcttaccctgctccaactcacaatttggcttcaaatcccaggtacttttattttctttaagttctataaatccctaatgaagtaaggactgtgtcaaaaagaaattgctttttggcaaacaagtttgttctttgttgtaagacagaagtactcaagacccgacagagcacaaaagctacctttcatttgttaatgtcccctcctctactccaacgcacaaacgaaaaagcataacactatattgctgttaatataggttaagacctagattgcaattttacaacaatgtggcaaaaatgtttactttgcagtctccagaaaaactagaaaacaggaaataggaaagcaaaatctaataaacatttacaagcaaattgattaaattctaaaggacacaggcctttcccccgacccttcacctgttcaatgacagccacacgtggctgcatcagacctggtgacatgaaggattctttctgcaacataccaaataaagcaaacatttattgcaaagacacagtctattgtttgccagggtatcccctggtatagctgcagtctttccaagtttctacaaaacacatagaatttttttttttaaaagcatgcctgttctgtgggcatcgtagctcaaccccacagtgagctaatggagaaacagatgatattcagagtatttgaacccaacctgcaactcctcattaatgtatgtcttcctctacttgattttccatacccccacactgctgaggaggctgagttttgagaatggacacaggaaagtagacggctgattgaactatctttgaatacattgcaagatcagcaacatgagttggggaattaccagcacctgtgatagaggggcgtgctttttggttagacagcaacttgccttaaaatacagtagaccttaggccactgaagcttaactttcagccacatcatggagttgtggtccaattagctttatactaataaggaggcaattattatagaggttcatcaagcaatgaagtagtcaacaatcaagcatgagacatgactacagaagctctatgtgtaggaaacactcagatgctcagtctcctcatcactaatatgaatatcataatcaaaaagtcctggaaccaacacctctgtgagaattaaatgaatcaatacatctgaaatttccaaaatgtcatatggattttagttactattatgattgacgtaaaaatggaaaaagtctgcttattcttaatgccctcctgataaaaagtaattccaaatctggaaggcccctttctagcttctactttaagaaaaactatcagacaggataaaaataattcttttacaatttcccagcaatctgctacctgtatctatattctaaaaacagaaccatagatgatgtaggtttatctacggcctcagagtaatgaagtgtagattcattagagtaagctgcatagatgtacaattaaaaaaaacaaaaaagctccaatgaactgaagacaatagagataaaaataaactcactcccagagctttctgattttactcttcgattagctttctgagaacaagagtaaagcaaaaaacaacacagccagccagcccttaaaaatgctttttctcttttccgggtaagaaacatcagcaggtatagtctaaggtaggagctagggaataacagatataacagcacttgcttggctacatgtaagagaaagatgccatttacacagctctaattagacagctcttagaaagactgcaagcaacctgtgaaactgctccaggtttcccaggctaagtgctatctacctttctatttaaaagaaattaagctataaaaatttgtctattcactgctactcaaaaaaaggaagtgcttttatgtatttttttaaaaagtaccacgaaataaaatgattaaacttcatcacagttgcaaacgattaacttgaaaatagaaaaactgaaaatgctgcagaaaccatgttatcagcctaaatcaatgatttatgctctgaagagtgtgagaaaaatgaactcaacaaataattggacaggatttattgtttttaaatgagttttttaagggatgggatatacattctaacaaatttcctttagtaccttaaatagaatttcaagagcaaggtaaaacaaacatgaggtgccaacaaactattcactagtgactgggaaagagagggagagaaatccggagggagaaaaagggatcatatttattgaggtaatatgggaaggagcacacagcaactatcaaaggacttctttattgggtgaaataattgtaattgttttgatgttagaacttcacatggaacatttatattcactataactaacattccattagaaaatgttggatagactgtattaacatattttcctaggtttttttggttttgttttacttattgaaaatacatccagttaccagatatgccccttgcccaaaaaaagaaaagaaaaagatattttacagcatgggtacaatgtgaaattggagaatacgttagcatgtgctcacagctgtttcaaatgaattgctatagacttacccacagaacactctgcagaagagaggctaagacacaactgaaacctagagcactagtgtggtggcaaatggtggataacattacagaaggaatagcagtagtttcttgtctttatttatttatttttaactggatttatcttagaggtggtgattccatgtgagcagctttctcatcttaaaggtgctaaattgcccatctcacaaataatcaagttattgtaacatcatctatattatttatgcttggatttttttgaattgctcctgttttgcaaatcaaacagcagatgatatatatttgaatttccatttaaaagaatagattcttgcccctgttgaaatctgtaatgctcttatgggtctggtttccatttatcaagcaccagtgttttcttttgcattacagagtacttcaaatatatgcagctttctcatttggatattagtttttccatagatcacatatcaaagaaattttgtctgcacttaaaagggcctatctgtagtagtaataaaatgcataacactaaagataatcttaacaattcccaatatttattatgtattttcttggtgccaggcactcttctaggtgctttacatatgttagtttatttaatcctcctagtaattgtaggaagtaggtactattaataatcccattatacagatgaggaaagcaaggctcagcaacttgtccgagcaagctctgcagaagcaagcagagcttcggatgcgttatcaggaaagaggttcctgagcagcatataggccctcctaagaaggtacttacttttacttattaaagagatgaagtgaataaatatatttatgttttggaactttaaatatatgaccctttctgtaagaaaaaaataacacactgctctgatcagaatgtgttcccgtaaattcatatgttaaacctaatcaccactgtgatagtactgagaggtgaggtcttaggaaatgcttaagtcatcagggcagagccctcatgggtgggattaggatccttataaaaaagcttgaaagattaagtttgccctttttctatcgttttggccatgtaaggacacagcattctttccctcaggggatgcagcaaaacagagcaccatcttggaagtggacagactgggccctcaccagaaagcaaggctgctggcaccttgatcttagacttcccagactctagaactacgaggaataaatttgtatggtttataaattacccagtctgtggtattttgttatagcagcacaaatggactaagacatggatccctattttactaagctttttaaaaaaaatcagattaataagcactagtgttaaagaatgcatattacatactaggtttattcttcatcacttctaaccctctcatggataaaaccatttaaatctgttttggtgagagtcacatagtagccaataatcctatttagaataagcccactaagctttttttttttttttttccttgaagaagctaatcatctcatactgtctaagatttaatatttatttgcctacttatcttttgatctcaggatttagaatcaatgttcagaattctggagatggtagagatggtcttacacatccttgttttataagaaaacaacgaaagactctaagtcataggttcttcctaaactggagaatgggcttgcaaagagattgtatatgcatgaactttctgaaattagtgtacaaataaagtatgtaagtgctctatgttttcaagtggggtttaaatgttcgtgaaattatcaaaaggatccagcttccccaaagagtgaatgttaactgcattaagtgaaatgctcaaggtcacattgttgtttaaactgaaatttagttttcagttttctgtctctttattcagtatatttcccaatataccttaaaacgtgagattaaacaaacaaaaaaacacacctgaaaatcatttctgtgtcatttattctttggaaaaattcattttgacttggagtctaagaacacaactgaagatctctagttctaagatttctatcctaagtgtttcaaaatgtgtatttgaaaattcttacacaatcttcccagccaaaaaggcatcagttttgaattaggtttgatgtacacaggcagggctattatgatttcaaaagccgctctgggcctgcgtagactaatgggaagaacagctgccttgagactgacatatattagtattttgaatttgtcacttattagctattgatcatacttaagtttgctgactttttaaatgcttccatttcctcatctgtaaattcagatcatgacaactagcttttggggttgggcctccataacatggtgctcggcatgtaatagataaccagataatcatatctattataatgtcttgtctttgttgttgaattgaaaagcagaattttaattttgctttatatttagacttggctaacacttttctaaaaatccatgtcaatagggcttttaaaacaaaatgttaattataatcctactaatggaaacagtactggcagcagtgaagattaattatactttagaacaacaacctcttttttatccacaactgcaataattaatttttgctaattagaaggcattataataaataacctgccactaattgataccccttggtcaacaagaaattaaagatacatacaacaatatttaaggtaagcagatcacctgtattatcattaggtttacatgtacttgacatttgttctgcaatcttatgactctggtccacctgaatgatgcatttgatgattcccatattgtgtccttgcctcaggttagtcatgccataaaataggaaatgagataggaaataggaaatgaagttctaaaacctaatatttatgttatccataaggctaatgccaaaagataaaatagatttttaggcaaaaagataagactgagcttttccacccatgctaagtgacttcagacactgtcacatcctgcaccggtaggaaagtgttatgagtgatgtgggaaagtggaagacccagaccaggaatcagaagagctggattctagcaagttatattatttatattctgtgtgactgtgtgactctgggccaatcctgtctgagcttcagttttctcatctataaatgtgaatacctatatatctagtaaaatactcacactgccgcttcactagactgttgtgtacagccaataaaacaacggataaggaaactacatagagataactcttagaagtcagaaatgaaagagattaccactaagaaaactgatattcagagaagtcaaggtcacctagctagttagtgacccaacctcagatttccttgttcttcatcttttggtttgtccattttcttttcctcataaaaacatactttctgaacaactttggattctacaagtttaggcataatattatatattctgtttatgcacatccaagtattagcttccaatatccaagtattagcttccatttggtctttatttgaaaatatttaccttttctttttttttttttccagatggggtctggttctgttgcccaagctggagtgcagtgggacaatctcagctcactgcaaactccacctcccaggctcaagcaaccctcccacctcagcctcctgagtagctgggactacaggcacgtaccatcatactagcgagttttttgtagaaaatatttatcttaactcattacaataaatcctattgccctcttcttcaggaattactattttctcttaagaactgcttaaacatagaggggatgccaatggtaattggatttgtcaaaaattcaattctgtttccatactgcttaccctataattaaacaattgaaaccattttgtaattaggactcttttgaatttattctgcatttttcctagcctaaataaaatgactgtgatttggaaagatgtcaccaagtgtcactattttcaaaaagttcaataagcacattactgcccacacacaattcctgattcttttaatttttccctgttattctctcagtggaagtaggatatacacttgctctactaaacaaatataaagacaacatcaatcactgcggccacttccagtttttgttgttctaatgtctgtcagatcactttgcaaaataatgtaaggagtaactagcaccactgagagaatagaacaaaaacacccaaattaaaactctcaaccaaagtcacttaagttagtaacattggttggaacacaaaacaagcacattaagttttataaattgtgcatgaagtcacttaatatttcagtatactaaaagctggccctgtattatcaaagctgtctttagaggagaagcctcagttagtggttctgtggttccagttgccagtattttctcttctgtgtttaagatacaggatgattgactgccctcaagaatacctgctggttagcgcttagtttaagataaaatgctgttcacggttgtaatttagatgaaagctctctatagctcatgaacttcaattaaatgcttctaaccttttgcataacacttaacatgttaggtcagctctagatttagggtgtatttgtgaacacagcactataaaaagacaggttttcgtgtgattcaagtgcttttgcttttataatataaaaccagcataggaacgaaatgtgcatagttttcaaccatcagaataaagatacaaggaggtatagtttttatccctcaacatactttaaagatgtggaaaataacaggttaagaaaaataatgacaaagtgagcaaaagtacagcgaagtggtagttattgaatgacctaattcttagtggaaacaatgctacaatagagcagaggcagactgacaagttccccaggcgagaccatgccaaatagattctcaacttacattcatttattttatttcaataatttaccttgcttttgctaatggaaaaaagatttctctctgctatttgtgactcagtttagtttttcatttattatggagatgatttaagagacttgagaccccccacaaaaaaacctgtattttttcacactttaaaatggaaaacatagagataaatgtaaggtaatcatccacatatgttaattacagtttttaaacagaatttgaaaagaagcgattacccatttgacattattatgcctgatctagtattggtaaaattttaataaatttaaataattgttttcagtgtggaaaaaggctaactcttgaacacttagtatctgtgggtgcctagaaaagggattatagtattttccaccatccaaagtaaatttattatgagaattttacaaaatatatctatgcaaaacaatgccatgttgaggtaaggagggccacaggtataggattgttcaaatgctgaaagatagtttttcttcccaaaaaaactggaaacaaatgtattaatggcctatggtgcctactgagaaagcttttaaacagtttcactttcaaataaattttggacgttgaggaagcaggtaggagatgtggtcagagttataaaataaagcggtggtcagcagagattttggaagcagaaaacagggacaggtactcgaacaactacagatgaacatctttcaactataaagtccttaaaataactgggtctgaagctactataatttatttgttttctaaaatatcttcaagaatgtaaacagtgaaccttcaagtatgaagaggccataaaactcttctgggcactaatgagggtgaacatggcatgtgccaagggtgacccaggttgactgttagaggcacagatttaagtggcctcctaaactattttctaaggactttccaatccaatgtgctcctgtagccagagtaactaatgaaatactgtgtgttgaagatgaacttctagttgttttaatatgccacacaaaagggatttatcattggaaaaatgatccgtcatgaatccttaatgaagctggatagagttgaggagcaaccctcatcttttaggaacaatcatgccctctggaacacactccttactgcaattctaagaggcagattaccaagcagtccacaaattagataaattagacatttccaacatacttaatttatattaaccaccacattatcaactttgaaattttagacagtccccagtggatatccagatttatttacaagcaaacaatcccctctccccttttaaaataaccatttagtttatgggcctcttctgacaatcacctgttcattcataacaaccaaaacccatcactaaaatgggcaacctcaattcgcttcccatataaaacatcaactacattatcaaatctttagggtaaaggcaagaaggtaatgagagatgcacttctgtcatatggtgtcagggatattgtggcctatgtataatttatttgtgtgagaaagaaaaagtaggaaaaagctatgtttgaatcttaattactttctttttttctttgagatggagtctcactctgttgcccaggctggggctggagtacagtgacacgatctcggctcactgcaactcccgcctcctgggttcaagtgattctcctgcctcagcgtcctgagtagctgggattacaggcgcccaccaccatgcccggctagtttttgtattctcagtagagatgggttttcagcatgttggccaggctggtctcgaactcctgacctcaggcgatccacccgcctcagcctcccaaagtgctgggattacaggcgtgagccaccatgcacagccatcttaattactttcagagatggttaataacctcactaaaacaatattctcatgcacatactcaaatccatgaaaataaaggtatcagtgatgtctgcatttccttaccttctatagctgataggagaacccgggaatgatcatatgcgattacattcgcgtatctattctttggtttgtttacttccaagtttgaatgttcccaagtgaactgctggccagggtcaattgactttaaaaggaaaacaacacatatacacaaaatcaatactgaaaaccaccagattataggcatttatcacatgtaataaacatgatttaaaaggaaaattctgaagccatacttcatcaagatgatcctaactgtgaagctgaacactaatgtaaccagcataacaaaaaatggttaatcactgcagaaacagtgatagtcaccaacattgattcaaatgaaaaaagaaatcaatacagatgttctgttaatattggaaaggcaggttcttaattttacttttccatttccctctctgctgctgtagtttacaagtcatcttggttcaatattccttccggttctgtaaaccttattttatattgattattcttccctattctttcctatctggacctaagctgagtctttaagttaactggtctttcactggcttcaatggacacaggctttactgttcattctttatctacatgttcacaacttaatggcaacttaaggttttgtctgtttctctgtaacacactaagaccaatattacaaggcaaattgtacaatttaaatagttaacacgaacagtaaagaagggaggtcagttaatttaatactcagatgaataagatacaacccaatgcatataaattgtttttctatttatcattatatattttctatttattattatgtgttattatgtttatagtttgctttttattcttgattttaacattagtttttttttctgattttatccctttctttgatggtacatttcaaccaaattattcaacaatctaaaataaacatcaaacaggtatataaagtatgtaatttaaaaatatttaagtagaatcatcatttcaagaccaaattcaggtttgatcataaaactctaggggacttcatttcctgaaacgttatggaaatcaaaatactttttctttcatcataggctactgataacatttaagatttataatttcattgttatatggaaacacaagttcattaatgacacaaacatgattttaaacgatcaaaatcaagttttcaagaatgataaaacaggtttatacccaggtaatttttttaaaatatactctattatgttaacataatttttagcagttatttttgatgccgggtatttttcatgcctttatgtgtatatgtagaagttgggagtaaaacatacccccaacagcatcaaaatactaaagatgtgcacactttctgtcaaaaggcacagaatttatcacaacagtaaaactcacaagtgtcaaaagtcaagtctgttagtagtcttgaatagcctccaagcattctaaaattctcagcagtacagattccagcctctaatttactaaggattattaaactgttttcctttcttagcctgtgttaatctatatacaaaatagtcaatcaatgagcagtattcaggaaaatattaataattatccataccttagagtctgaaaactaatataattaagggactttctagtttgctcttccagggaaatttttcatctcccttgcagaaattaattatctccaagcatgctatgagccgaaggtattgaagcattcagatgtcctggtggaagccttcaagtcaaccttgaaccatgtccacacagaacagctccactcagtgatgagggcctgccttaaaaatctctcaaatttgcaatctcattgctacttcctacatccggaacattggtatctgttgtctgattgaaatcccttctctaatctcttattccaatccactcttcatactgctgccaaagttgtctttctaaagcatagctctggacaggttggctgcctgtttaataacttccactggctctgtgtgacctacagcctaaattctaaattcctacctatgcagctttcgtcatctttgcatctacactacacctggctcagtaaatggtccaacagatgttatttaagcaaatgaacagaattgatgaataaatgtttttgagaaaagttcataaagagaaatcatagagtaattcctctatataacatgagagttagagaacaaattatggaaacttcattgtacagtataccacaattatcatacttaacacccattatcatatggcttagtgattaagtatgtgatcatggaattataactaccactgctattccactttatactgatgaacattattggatacataagcttcttacacatcatttaaacatcccaagaagctactaagctcactggtatacgtacagtgctccctctgatatccttgttttacttagactaagatcacccacagatgtataagatggcatgcatttacttatagcaatgaaattgcatctattaactgaaacaaactgttaactcatgtccatttccactcttgccacatgttttcagccttctgtaggacttacttgatacctacattgaagactttaaaaacgagtaacagaaacatgagttgtgtgccacctatgttagataatacgcttaggttcaaagtgtggcccatgagatgaagaccaacaaataacaggataattataaaaatacgtgctaggtcattatgctttatatgaagaattatgcttgattttcacaattgttacaaggtaggtattgtttttttccatttggcaggtgagaaaactgaagtaaagaaagattaatttaattattcttactgagggcctacttcgtgacaggctctgtgctacttggtacttaagtaatttggctaagctcacacagctagattcatacagttaccctcaaaccaggtctgtgtgattccaaagctcaactgataattaacagctggtaacgactaagccatgatactacttaactatccagaatgccactgcaaaaggaagaagcccaacttaagaaacacacctacacatcactatcctttatttcaccaatccaaatgatatttcttcccaacttatcagcctgtgtcattctggggcaattacataagaaatcaagttttaaaaatgaggttggcttcacatggatgataaaacagatgggatgcagcttacgtttatactcgttttacacggatcaaacaaacattgattaaataatgctgacttgtctttgtgcaacacagcactcatccatctgtatctatctgtctgactgaacgtttaacaaaacacaacacgggtcattatttttggagcttgtcagaatgctgacagcagtaaactcagtaaagaataacaactgaaagttggtgaggtatactaagatctttcatatttcaaaaaatacataaaactggttgaggaaaatcaaatttcagttatccatattactaagacaaagagatcatgaatgagtaagaccctaattgctggtgacagacacagttgctttgcctctctgttctcaggcttctcttgctgctgtcctcttaaggaagagtgagatggccaaaatgaagaaagagcaatgtagaccctgaggaatgtaaaagttgactttcacttcaaccctgtattttcggtcagtccaccctgaccatgcatcttttttactataaagctaagctgaggttacccaaatattaattattcaaaacaatttgaaataagcacctttgttcttaatggactcaattccttcttttgggtctgctgctgttagtgtttggttttcctgagcttgactcctagatatgtctactcaactctgtccacccaaataatcttccatgggatacccttgccttcccagcactcaatctgaagttttaccttcccaagctgaaatcctggccaggctttcttcagtctccgttgtggagaattttgcaagttagaaataaagcaagctagatttatttaagtaaaagttgattaatacacttttatacatgatacgaaatacataaattatcacagaattcacaaaaatgctacttcgtcgtattttttgtgtctccagccaatcaaaaagcctcttgaaagacagatattggatgaaccccatatagcgtctaaagttttaccaagatgccgcaccattttacattgcttccctgcctgcacactgggcacttgactcctcctccccaccgcagcttttgactaaacctttctaacgctaacaacagatcttcaactcaaaggctttgcttactcagaaaaaatgacccaatagaagaaaaaatcctattgtgagtgatttaaagaacaacgggaaagtctcaagcagatacttgctaatataaaacactttgcatttatttagtctttaacttgatggtctgaaagttctaatcctttttatttgatcaactagaagtttatctcaaactaggtaactgaaaaaataagctatagcagatggattagaggtttgcattgtattctcgacaaaaactcagaattaaaatataaatatatccaatagttgtaactaatacttagataacatttactatgttttctttgtgctttgtacatactaactcatttatcttcacaaagaccctagaagtagttgccattatgattacagttatgtagatgaggaaactgaggtatagataagacaaataactttctcagggtcaaacagctagcagggagagaggccaggctgggggtccacatattctggccctggaggctgagggcccagccaccataagatgctttctctctagttaagctggagaagattccttgaaggtttcacacttgcctttcaactattctcttgaaacacaacgcacagaaggttgggaacaatctgtgtagtactgctgaactctatttgtaattctaaactccaaacaagagagtgatcatcaatttgcacatcagattacagtcaccaagtaaaattatatcctgatatgggagtaacctttttcaataatgctgaagtcattatcttaaagcaaagtcctttaatcattctgcaaaattcaacctttttacccagaagaaaaatataattcaaatgtgcaaaacaccatacaatactagttgctctgtgtttcactttccctcatcccgccaagagaaaaacctcaaaatattccctttagaaactcatcaaagagaaaccacaaaaaaagatcatcctgtttttgtgtgtttttaaaacaactaacaaaaatttaattatatagaaggaatagaccagttacttcactcgtcaaaccatgggtcagactaaccattctttttacagggaattgaactttcaatgaccttaacttccaaagaaacagtatcttttcacatatctccccttcagtaggctcatttggttcttagtgtggttggctctgagatattctcaagtcctttctgaggtttagaagagcaatctaccattcactgtgtattctgcaattatgccttttaaaattctcattcattgtctctctcttctctgtttgaaaatggtaaattaatatatgcccatttggaaaagaccacgtttgcatagatgggaagggctatattttgcacaattagtaaaagcctgcaattggcataatgaatactttcttcaaagagaagagcatgagttcagttgaatcctatgatgttttagaaactgaaatgtgaggaaggagtggaaagtccagtggtgaacaaaatctggaagtcagagaacagggtgttagctttctggctgcccctggttagctctggccggtcaggtaacttgggtctgtttgctctgtgttcccttttcctcttaatgtcaacctagtgtcaggtgtgtgtcctcattttctcttatctctctttgtccaattagttatcaaatcttactgagtctctctctgtaagagcacctctgatccaggccaacattagagtgtgaaggattgaaataaagatttttcaagactctcagtattaacaaatgaatggatgtgggagtgccccacctttagtagtagaaaaggcatagaaaatgtataaatataccacactcattgaagtcatcaaaaagtgtttcagtcacatatttttgtacacagttaaaattctggcttcagataagtgataaaatgcatcagctttacctgttgtctaatggttgcatttgaaattttgactctaacatactatataacaaatacgtatagaaaattacttaaagtaataatatatattattagaactgacatgcagggaacaaaaaggataaactatgctcatagtaaatcattcatccatggcaagtgagtaaatatctgaggtaaacttttgataaacaatttattctaaattatatcatagtactaaagatgaattagtttatttcactgaggaaaccattgattcccagaagtatattagaattatcttaatctaacgtggattaaaaatgatgaaaaacaacaacaaaaccaaaaatacttaattcttttttttaactcagtaggccaacatgaggtactctctagaattcagataaagtgttttactattttagtgtgtgactgtagaaaagattatttttgagagatcgttccaaataagaatccaaaaaagaacatacaactttaagattaaagatttaaataactagattttttactatatacttttttaaaattttttatttatcttttatttttatttttattttttttgtggcagggtcatgcctgtccaggctgaagtgcaatggcgtgatcttggctcactgcaacctctgcctcccgggttcaagcaattctcctgcctcagcctcccaagtagctgggattacaggcatgtgtcaccatgcctggctaacttttgtatttttagtagaggcagggtttcgccatgttggccaggctagtctcgaactcatgaccttaagtgatccacctgccttggcttcccaaagtgttgaggttacaggcgtgagtcactacacccaacactatacatggctttttaatatgccaaacattttcctgaatattactaaatgcagaagaaagacatttctagtttccaaagacaatgtgctagaggaataagatcagcgatatgtgttaatcctaatgttttcatttttagctatttatctcctacatcagataaggtgaataataagaaagagatggacagatttataggtgatgttctttttttatttcttcacatctttgaattctatatagttgatgttcttaagaatagaatgtgtcattggaaatcactttacaaatacaattcacagattagaatttctgatgttatttgaaaaagcaaagagtattaaagaatttccaggcagtttggggcaagcaaatgtattagaaagttattaaactgctttgtttaaatagacaatgttgactgaattggtaaaatgtaattacgatgacttataagaagaagtcacttgatctgcaaatcacttataaagtatgatatttaataattaaagaggatcctggtgaggtggcatgtgcctgtaatcccacctactctactcaggatgctgaggcaggaagacttcttgagccctggagtttgagtccagcctgggcaacacagcaagacccaatctcattaaacaaaatattaaaataggttatgcacacctagaaacattaaagagtatggcaacattaaagagaatattattgagtataggtaacagacaaaattatctagcaaatacaatcaatgtgcagcattaaacactaatttacggtgttagtaaattagtgttttagtaaattaggaagaattaattcacagctgcatcctttcttttccatggataacaaggtcccagtttttgccaccaaattaactagatgaatgcattaattcctcactgctctttgaaaatgctgacacatctgtatagatcccaaagtattaagcgaaaagtacctgatgcacagttattactaaaagaatgctagatgttttgccttctcttgcctctaccctgtgacttgtataagaacatccctgatagaagactatcttagcctccaaggaatatctgcattctccttgatgctaacggtgccttttttgatactgaagtataaaactgaggcaactgctcaatttaacaaataaatctatttctgctctcctacttactatataacatgcccatctatgtaatttgcaaactgatttacttttccggcagagacaacaaaaaagagcacagctgcatatggttctcactttttgcatttcatataatagaaacttgaccactcagaaaactcagtacataagtagattcaaaagaaaaaacaaattatgaatgaatagcttggtttcacaattgttgtgcgactgatattacaacatcatttaagaaacactataaggaaaattgttaagataaatcatcttcatttttaaaagtcggattagttgagcttaagtgataacagtaattcttttaatcaaatatgaaaatgtctagcctaattttaaacatacgatttttcttcctattatttttactttgcatcctaaacatagatgtattttaggctttcatcattgctttgcttgtcatttaacagaaagtttctttattaagtctttgtttctttttccatatttagtttcagatgcaggtggagggaacagatgaatttctaaattgaaacataaattaacttttgttaatgttcagtcaatgcatttcaaatctcattttctgattcagaaagagataaaaattctacatccaaaatgaaataagaaagagtaatgttttctcccagtctttgtcggaactcagaaaatcccaaataatcacttaaaaaactcttgtaccccatttcataccaaatgtatttagtacaactatctcactaaaaaacatgactatccacatgtgccttttgggcacagtatatataccaacaaccccttgccattaataccattagtgcttgcaggtaaggtagcaatacaccatactaaatataggcttctaatcaaagaagtcacacaggatgatcattaatacttatatccatggtgctcaggtgtcttagaaagtatttacaatctaaagtgtcagtatatttgtctcttacatgtgataaaactagaaaggctagaacaaattaacacaatctagaattttagagtttagtatctttctaaactaaaagattactctcaaagattagtatttttaaatgtatattagttttacattgtaaaattagggactcttctaagttaaatattagaaaaaaaatcagtacattgatgatcttatgtattagacctctggaaaaaatggaatcacttgagaacactgctatggggttgtgatttatctgatgttgtatattttgtatttagcatacagtgaattttaaaatgtatttgtggaatgaatagctaagatacattacaggtaggatacacagcaacaattacttttaccctagtaccttagaactagttaaataaatttctcagccaaaggtgtgatgatgaaacaaatatatattggaatagaccagagatataaaaaaaaaaatttaaataaacagaatggctcccagctcacaagtggctacaacccaattcataaaagccatctttgactttttgtgcatctgaaattcattctaagctatcacctgtgacagccttttgtactgtgttttccaatttttacatatgtacttaatatttggaagtaacacataatggctacttgccaatgacagttctgtataaactgtattacccaattttctgcacagcagtatgggtttatacaattagttggctattttaatacaatagtttttttcatttttttggtttgtttgaacagttgtgctccccaaagatctcaaggccacttatgttgggagttatagggagaatggaaggaatgtgatcagatggaaggataaatattccagaatggagctctacaataggctgagtttgagttaggtagtccctacatcccagtttacacctactgtcccagcgtagttattaataggaccctttctcactctcaaagtatcccagtttaggcaagaaattacatggccaccccaaggtagagctggttctacctaacttcctcatattcacatctatatctaggcaagcttcatgacagtgtcataaccatcagtcaggcatgtacatgtacggggagggaaggcgtgcaggggagcaggagagagggagggagggagggagagagggatggggagggagggggagagagagggagggggagagagagagagagagagagagagagagagagagagagagagacagacagacagggggcagtctctgctaaaaagtaagtacacttacaaactatcacatggataggtgggtgggaaaaagtaaagagaaatttctgcagtgcaatacctatctccaattatctaacactattgatgcagcaatgagatactgaatccagaatgagagaaggtagctgaccttaccatgattcacccttgttcaccttaactatggtgctgcacacaagagagaaaaaggaagaaagcagagaatgtgtttctcagcacacatttactgtgctctctaacaaaccaacaatttagccctttctgataattgctttttcctccttctaagacagcattggagatggaaggaatgtgcagtacataagctggctggatatgtattcaattgtgattggatatgtattcaattatgatcaaagtaaacgaactaattttacaaactgataattcattctatagacatgatttttaatcttgtatatcacctataatattttataatatttaaggctgtgattggaatattaaatgtaattatgtcataatttcttttttaatttttaatgctttggaagtaaaaccatagacctattgtttgagtattacacaattcaaccatgatacgtgtctccaaatgtaatataatctaaacagtaaaacataaattaacatgtcctttaaaaatctgtgtattaacatatctaaaaaaatgctgtgtcagttagtaggagagaaagcaagccacagacatgcagacaatggagggccagggaggacgatgaccatgaaaatctggtcctctcagaatgacggtagcatttagacgtcacagcttcattacatggccaccaagaccacacaactaatgcaagtgaggtttccagaaaacagatctctctcaagttttagaactaagaagcaagttgtaaagtgaccatatcaaggtattctcaaggtctggaagcctgtcttgggatcactttgccttctctacctggctcaattcaccccactgtgaagtcagtctttgattcatccatttcctggtgttagacttcagatactaaactctgtcagaaagccttaaaagtgaaaaaaaatatttcccctgaacacatgtatacaatcatttaaaataactttgaaaagcttggaaatagccttaatataatagtagattatatgaaaaagtgtgaagctattaaaattgttatgcatctagtgacgtggaaagataaacttttactgttaaagaaaaaacatgaaacagtacttttgttaaaatatatacatatgtatacacatgcactgcatacatacatgaatacacacacatataaaaacctagaatgttatacaccaatgctatcagcagttatctctgagctgtgataaatgacaattattttatttccttatgtttactatccatgttctttaatttttccatttatgaacattgaactactttccaggaagagggaaaaaagagagttgcagaatacttttcacaactgcacatgtgacttcctcttgtcatgtcagaggcagaaggagcagactgtaggactcaacactctggaggggattttgtgaaatccatagaaaatttttcagctggcttttggggtccatgaaggtaacttcagtgtagatttatgaccaggaaagaatactgaagggccaacacaagactagactgtcttactctaaactcaccaaaggatggtagtgagaaataatcaggttaaattacttctgattttgaggattatgatgacaatgaggggtggattatcactacttacagaatctcatgtaattcttaaaacaaatttagaggtatcttagatattgttatctccatattacagataaagaaattgaggcatagaagggttaagatactttccatgagtcactcttggtggtccataaattaggagaactgggatgtaaatgcagagattcctgactttgaagacagagctcttaactactacactctaatagatacgtaaattataaatttattatcatggagcataattccttatttaaaaactgtggacagtaaggaaaatagattaaacaccagatacctctgccaattttggcttaatgatgcattcatcccacagttgttattgccaaaattttttgataatgaaagacaagccacagctttctataatatatcgttagattctaacatgactcctatcaaatccaaaagagtgggaagttaagtataatctttactttaataattgggaacaaaaagacacatctcaagttctccctggtttctacacacccaacagtgctgccccaaaaccctcacacaccataaattctgcgggaaaagagagaaagctgatgcacattcattccttagaactgaatagccataatgcagcaaagggtagagctgtattggcagaaactactaagaatggtgagagaccaataactcatgaaaaacaagtctacactaacagttttaatgactattctaatggtttaatggatagcactttaataggatttctagtagaatctgaaagcttctgaaagcttgtcttcaataaatctgtcattaacaaagaactgcattgcttaactacataaccatagtttactgagtctgaacacagaaaaagtatagcagttgtcatcctgtattaccatcaccttttcaagtattctattaactactgtgagagagacagctacaagatcaaaatgtaggctgccagtgaaagaggcatatttatactaaggggatgcagtagacattaaataaaatacaacagaaagctcacaattatagcttgtgtccaaagaaaaagctgaaacagtaactgtaatccaaatacacagatatactaacaatgaaatttcaaaaactagctttagttctctttgaaagagtattaaatgttttggggtgatttgtttttgaatgcctattgcactctgtgtctacatttgacttattttgtattatgttgcttcctgtactgatttaatgttctttaaagtcaggaattgccatgttgtggtgctcagggtacataccaactcaatataaatattggattggctataatcagtcctagtgaataattttaaattccagcctttggctctgttttcctctgtccatgtctgaggttctcatttctgacttttttgcactggaatatttcttgcttggagagcactttcttatccttttcttttttttttgcttctaaattctaccttcctttcaacaaggttcagcttaaatcccactctcccaattcattactgcctggagctttctcttacatgcttccatgtgtgccactatcatgtgttacagactggagcatccatttggcaactagctacgtttagccttgtagcatttcttcttgtaaagttgtttgaattcattaccataacttatcttttcatttgacaattctttatttccccaactctatagtaagtttctcaatggaaatactgtctggtatatatctgtgtagtctagaaaatggctagcccagtgcatgtaaaatgtatgtaaaatacatttttttttttttgtaattttaatcatttcttgtctcaatttctgtgaaagtctttcaaggttgggaaacttatttctttcggaattacacgtagtcttatatataccaggatcacaaacctgaggataacagactgatgcattcttcgagtatgttctatcaatgctgatagctgtaaattcatagactttacagcaattatactgattatcaaaattactgaaaataacccattggctaagctatgaaccattcaagttgtacaacttgaacaaggcctagagtatactggaagaataaaaataccttctcagatccaatagtaggcaaatttgagtaaatatacccatgctaggagatttatatatgtctgtctggtgataatgtccttgtaaaaatggctccttcattcaaaatcaaaagcattatcacttgaggcaggagttcgagactggcctcagcaacatagtgagacatcgtttctaaaaaattttaaaaactcatcacaaaagatggtaatgcacacctgtagtcccagctacttgggagcctgaggcaggagaatagtttgagcccaggagttcaatgtcgcagtgagctgagatgagatcatctcactgcactccagtctgggagacaaagcatgacccactctccaaaaaattaaaaaaaaaaaaaaaagaaaagaaaaacaatattattaatcaagctattcaataaaagtaaacagaattttattctgaaaaagacaatatgtttgaggtcatttaaaacacctattgtttattaagaaaacttattaagtgatagattcagtctttacacagagtgagtcttatttactccatttcaagggtatgctttgaaaaccaaacaatatagcgaacaaaaaacaaaaagcctaaacaatttcataaataacaatatgggtaaagtaacaaacataaatggcacgctctacaagatagagcctcttttaccaatataaatattaaaatataagcaggtcatcttaaccaatgatttacaataagggaagaaaagaaaaatatctatatgattctttggcatctcatatttctttctcgggggggcatatatttcatccagctaggggaattttggatgaaattataaaacaaaatactatgcctgttaactgctcccacagcttagagaaaccctaagaagttctgccagggaagcataatagagaacaaatgctgttccctaatcttatttcacatacattcaagtaacagaatatgagaaagagaaacatgagttttccctacagcgggtccaaaaatctgagagtctgaaggattgatttttctgtttaaaaaattaggaaatactttgaaacacacattttagacagttgctaagacactaactgccctgacctactgaatttccacatctttgtatgtattgagtgtcagaaaaagaagaaatcccatcacccctcacatggtacatgtaacaaacgtagacaaaaatgccagtcccattaaccatggagtaaaactcatagctgcataccaaaatcctgacaaattctagttattgtggctttggttaagtttggataaaaacactaaaggaacccttggactcagaattcaagggcaaaatttatgcatcatttatttttgtactgcagagtctagcaaagtacctggcacattgtaagagcttagtaaatatctgttttatgagatgagctgaatataaagctggaaaattatatagacttttaaagaaggagcattcatgatcttgaaaattgtttcttaggtagctaaaatttttatttttatttatttttaaattttttgtagctaaaatttttagaattggtcttcttgttctcaaggccatttgggagaaatgagcagctttgtttcaaagttcatctgtttattctccagcgaaaattataatccttggtctgtggcatcacaattggttgctgtgggaatgattatagatcaaaaacaaaacgattatatcccttttcaagagcaaatgagtaccaagagcagatgaagacttaaggaaacaaagatgttcttttcatgcaaatatttttacaatacaactgtggagagataaatactgaagctggtagtctttatgaaatttataggcagatttttagctttggggaaagacagctccctttgccctcagagttagctttgagacatgaatactacagatcatttttctttttttttttttttaaaaaaagaaaatataaagacactgagagcgtaggaaaagtgagttctgtgatcagtattcccctgttgttttatttcaggcagaagaatgtcttcctcatctgtgtacaggatcactgtcagggagcttgatgtcctgcactgtcctggcaatatgttgcccaagggaggtccaccaaggaaagccaaaggtgaattc

What is claimed is:

1. A method of determining susceptibility to asthma, comprising obtaining a biological sample from a patient and detecting at least one allele within the PTPRD gene, wherein said allele is a C at the rs2279776 loci or a G at the rs767674 loci, thereby indicating that the patient is susceptible to asthma.

2. The method of claim 1, wherein detecting both a C at the rs2279776 loci and a G at the rs767674 loci indicates that the patient has higher susceptibility to asthma than if only a single allele is detected.

* * * * *